(12) United States Patent
Cibelli et al.

(10) Patent No.: US 7,858,308 B2
(45) Date of Patent: Dec. 28, 2010

(54) IDENTIFICATION OF GENES OR POLYPEPTIDES THE EXPRESSION OF WHICH CORRELATES TO FERTILITY, OVARIAN FUNCTION AND/OR FETAL/NEWBORN VIABILITY

(75) Inventors: Jose Cibelli, East Lansing, MI (US); Javier Crosby, Santiago (CL); Emilio Fernandez, Santiago (CL); Arif Kocabas, East Lansing, MI (US); Guilherme Jordao De Magalhaes Rosa, Middleton, WI (US)

(73) Assignee: Michigan State University, East Lansing, MI (US)

( * ) Notice: Subject to any disclaimer, the term of this patent is extended or adjusted under 35 U.S.C. 154(b) by 0 days.

(21) Appl. No.: 11/584,580

(22) Filed: Oct. 23, 2006

(65) Prior Publication Data
US 2007/0238111 A1 Oct. 11, 2007

Related U.S. Application Data

(63) Continuation-in-part of application No. 11/437,797, filed on May 22, 2006, and a continuation-in-part of application No. 11/091,883, filed on Mar. 29, 2005.

(60) Provisional application No. 60/556,875, filed on Mar. 29, 2004.

(51) Int. Cl.
*C12Q 1/68* (2006.01)
*C12P 19/34* (2006.01)
*A01N 43/04* (2006.01)

(52) U.S. Cl. ............ 435/6; 435/91.2; 514/44 R
(58) Field of Classification Search ............ 435/6, 435/91.2; 514/44 R
See application file for complete search history.

(56) References Cited

U.S. PATENT DOCUMENTS

| 7,041,648 B2 | 5/2006 | Mantovani |
| 2003/0124551 A1* | 7/2003 | Pappa et al. ............ 435/6 |
| 2004/0081958 A1* | 4/2004 | Eilertsen et al. ............ 435/6 |
| 2006/0024693 A1 | 2/2006 | Cibelli |
| 2007/0054289 A1 | 3/2007 | Cibelli |

OTHER PUBLICATIONS

Bisseling et al. Fertility and Sterility 68:907-911; 1997.*
NCBI Accession No. AY324387 (Sequence PRI Jun. 24, 2003); pp. 1-6.*
Jansen et al. (eMJA 178: 258-261; 2003.*
International Search Report, PCT Application No. PCT/US07/12157, mailed Sep. 11, 2008, 14 pages.
Jansen, P.S. eMJA 2003 vol. 178, No. 6, pp. 258-261; Abstract.
Mckenzie et al. Human Reproduction vol. 19. No. 12, pp. 2869-2874; Oct. 2004; especially Abstract.
Salustri et al. Development vol. 131. pp. 1577-1586 ; especially 1579 and p. 1586, Mar. 2004.
International Search Report, PCT Application No. PCT/US05/10360, mailed Sep. 29, 2006, 10 pages.
P. Lonergan, et al., "Oocyte and Embryo Quality: Effect of Origin, Culture Conditions and Gene Expression Patterns", Reprod. Dom. Anim., vol. 38, p 259-267, 2003.
Fair et al. Mol. Repr. Dev. 67:136-144; 2004.
Velde et al, The variability of female reproductive ageing; Human Reproduction Update, vol. 8, No. 2, pp. 141-154, (2002).

* cited by examiner

*Primary Examiner*—Fereydoun G Sajjadi
(74) *Attorney, Agent, or Firm*—Hunton & Williams LLP

(57) ABSTRACT

A genetic means of determining whether a female subject produces "pregnancy competent" oocytes is provided. The means comprises detecting the level of expression of one or more genes that are expressed at characteristic levels (upregulated or downregulated) in cumulus cells derived from pregnancy competent oocytes. This characteristic gene expression level, or pattern referred to herein as the "pregnancy signature", also can be used to identify subjects with underlying conditions that impair or prevent the development of a viable pregnancy, e.g., pre-menopausal condition, other hormonal dysfunction, ovarian dysfunction, ovarian cyst, cancer or other cell proliferation disorder, autoimmune disease and the like. Microarrays containing "pregnancy signature" genes or corresponding polypeptides provide another preferred aspect of the invention. Still further, the subject invention can be used to derive animal models, e.g., non-human primate animal models, for the evaluation of the efficacy of putative female fertility treatments.

14 Claims, 31 Drawing Sheets

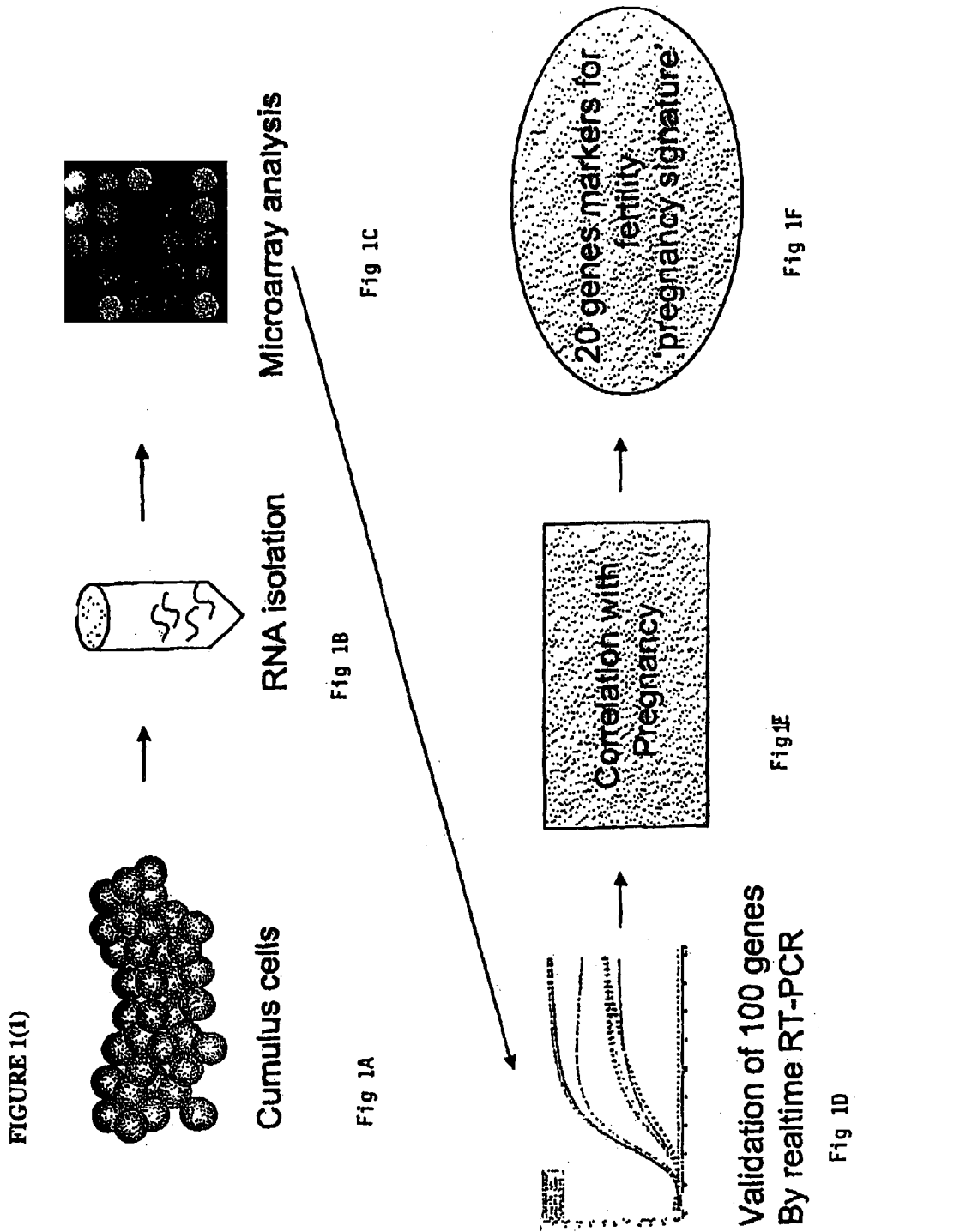

FIGURE 1(2)
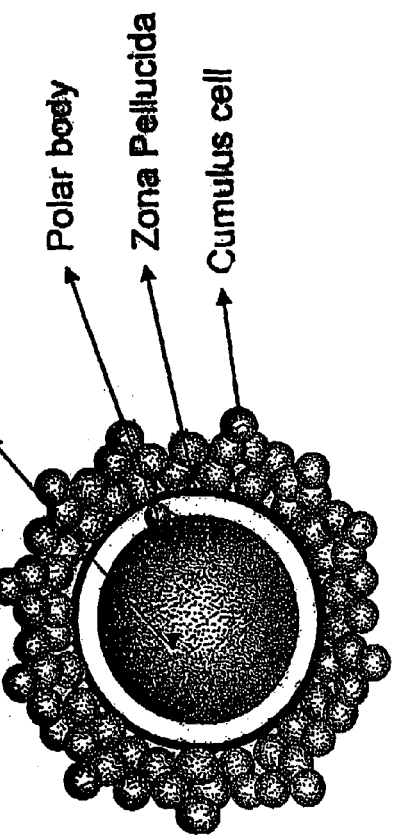
Fig 1G
Freshly ovulated human egg
Polar body
Zona Pellucida
Cumulus cell
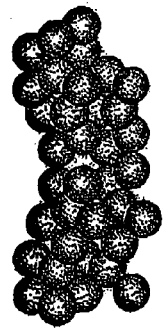
Cumulus cells to be sent
To our laboratory for RNA
profiling
Fig 1I
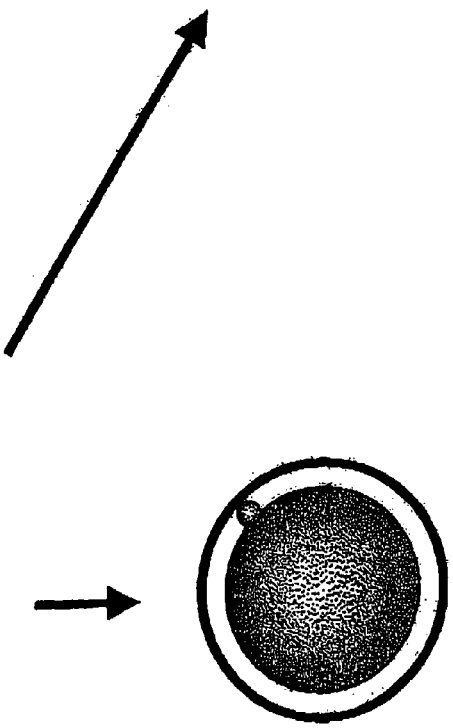
Egg to be fertilized and
Transferred into the uterus
Fig 1H Figure 2.
a
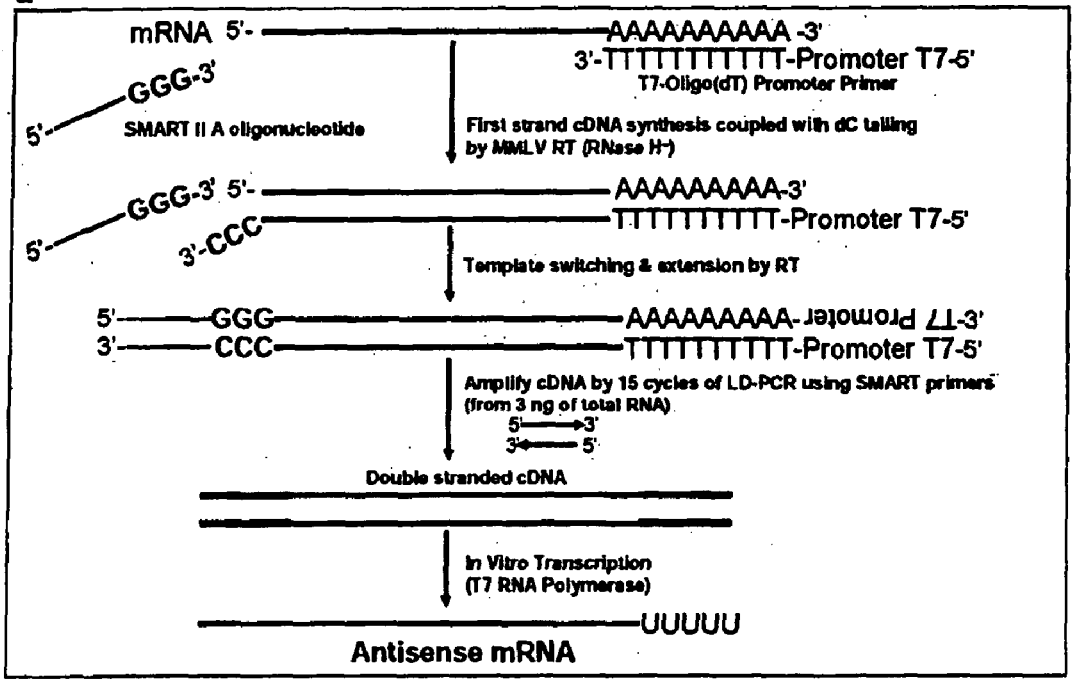
b.
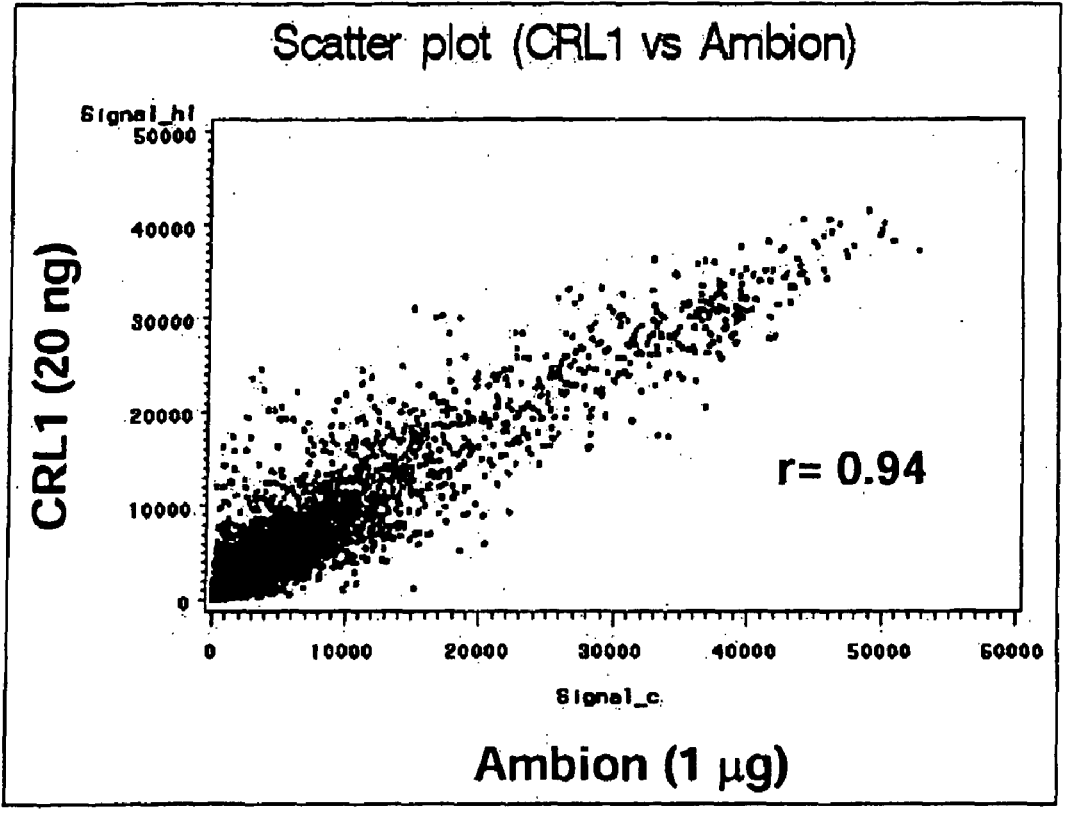

FIGURE 5

| | GO Biological Process term | Representative genes expressed by the human oocyte |
|---|---|---|
| 1 | Cell Cycle<br>  Mitotic cell cycle<br>    M phase<br>    Nuclear division<br>    Cytokinesis<br>  Meiosis<br>    Meiosis I<br>    Meiotic prophase I<br>    DNA recombination<br>    Sister chromatid cohesion<br>  Regulation of cell cycle<br>    Cell cycle checkpoint<br>    Regulation of mitosis | ANAPC1, ANLN, APC10, BIN3, BRCA2, BUB1, BUB1B, BUB3, C2orf6, CCNA2, CCNB1, CCNB2, CCNB3, CCND2, CCNE1, CCNE2, CCNG2, CCNI, CDC14A, CDC20, CDC23, CDC25B, CDC25C, CDC27, CDC45L, CDC5L, CDC7, CDK3, CDK7, CDK8, CENPE, CENPF, CENPH, CETN3, CHC1, CHEK1, CHFR, CKS2, NAP1, CSPG6, EML4, ESPL1, GAJ, GPR125, HCAP-G, HCAP-G, HSPC135, HT014, IDN3, KATNA1, KIF11, KIF23, KIF2C, KNSL7, KNTC1, LIG1, LIG4, MAD2L1, MAD2L2, MAD2L2, MPHOSPH1, MRE11A, MSH5, MVP, NEDD5, NEK1, NEK2, PAFAH1B1, PARD3, PCCB, PLK1, PPP1R9B, PRC1, PREI3, PTTG1, RAD1, RAD17, RAD51L1, RAD54B, RAN, RBM11, SAP30, SKB1, SMC2L1, SMC4L1, STAG3, STK6, SUGT1, SYCP2, TARDBP, TPX2, TTK, UBE2C, UBE2D3, UNG2, ZW10 |
| 2 | Nucleic acid metabolism<br>  DNA metabolism<br>    DNA replication DNA<br>    replication and chromosome<br>    cycle<br>    DNA repair<br>  RNA metabolism<br>    mRNA metabolism<br>    mRNA processing<br>    mRNA catabolism<br>    tRNA metabolism | ACF, CDC45L, CENPE, CENPF, CENPH, CHAF1A, CHAF1B, CPEB1, CPEB4, CPSF2, DNA2L, ESPL1, FEN1, FNBP3, HCAP-G, HNRPA1, IDN3, LIG1, LIG4, MAD2L1, MSH2, MSH3, MSH5, NAP1L1, ORC1L, ORC4L, ORC5L, PABPN1, PCF11, PCNA, PLRG1, POLA, POLB, POLD3, POLE2, POLG2, POLQ, POLS, PRIM2A, PRPF3, PRPF4, PSEN2, RAD17, RBM17, RFC4, SF3B4, SFRS12, SIP1, SLBP, SMN1, SNRPD1, SNRPE, SNRPF, TFAM, TOP1, TOP2A, U2AF2, XRN2 |

FIGURE 5 (Con't)

| 5 | Ubiquitin-dependent protein catabolism<br>Protein modification<br>Ubiquitin cycle | ARIH1, ARIH2, BTRC, CDC20, CDC34, CYLD, DD5, DKFZP564G092, FBXO11, FBXO8, FLN29, FTS, HACE1, HIP2, HSPC150, HSXIAPAF1, LMO7, PSMA2, PSMA5, PSMA7, PSMD9, RNF14, SAE1, SIAH1, SMURF1, STAU2, TSG101, UBE2C, UBE2D3, UBE2G1, UBE2I, UBE2L3, UBE2N, UBE2Q, UBE2R2, UBE2S, UBE3B, UBPH, UCHL1, USP1, USP10, USP13, USP15, USP16, USP2, USP21, USP26, USP30, USP34, USP35, USP36, USP37, USP44, USP49, USP52, USP9X, WWP2 |
|---|---|---|
| 6 | Phosphate metabolism<br>Protein amino acid phosphorylation<br>Protein amino acid dephosphorylation | ACVR1, ACVR1B, ACYP1, AKT2, AURKB, AURKC, BMP2K, BMPR1A, BRAP, BUB1, CAMK1D, CAMK2G, CCRK, CDC14A, CDC25B, CDC25C, CDC42BPA, CDC42BPB, CDC7, CDK3, CDK7, CDK8, CDKL5, CHEK1, CHEK2, CLK1, CLK2, , CLK3, CRK7, CSF1R, CSNK1E, DAPK1, DUSP10, DUSP5, EPHA1, EPHB1, ERN1, FER, FGFR1, FGFR2, FYN, GPR125, GRK6, GSK3A, HMGA1L4, IGF1R, IKBKB, ILKAP, IMPA1, INHBA, INPP5D, KIT, MADH2, MADH5, MAP2K1, MAP4K3, MAPK6, MAPK7, MAPK8, MAPKAPK5, MARK2, MARK4, MASTL, MELK, MKNK1, MOS, MTM1, MTMR3, NEK1, NTRK2, PACE-1, PASK, PDPK1, PLK1, PLK3, PPM1E, PRKAR1A, PRKCG, PRKG1, PRKRA, PTEN, PTK2, PTK9, PTP4A3, PTPN2, PTPN3, PTPRG, PTPRH, PTPRN2, RIOK1, STK24, STK31, STK38, STK6, TEC, TEX14 |
| 7 | Reproduction<br>Sexual reproduction<br>Gametogenesis<br>Spermatogenesis | AXIN1, BCL2L10, BMP15, BRD2, CCNI, CHEK1, CUGBP1, D8S2298E, DAZ, DAZ2, DAZL, DNAH9, FLJ10511, FUT10, GDF9, GMCL, HIST1H1E, HMGCR, HSF2BP,HSPC039 , KHDRBS3, MAGOH, NASP, NDRG3, NJMU-R1, NOC4, NR6A1, NY-REN-24, ODC-p, PIWIL1, PPP1R12A, PTTG1, RNF125, RNF138, SOX30, SPAG6, SPATA2, SPIN, STRBP, TDRD1,TEX15 , TSGA10, TUBD1, USP9X, WFDC2, XRN2, ZP2 |
| 8 | Chromatin remodeling<br>Chromatin modification<br>Non-covalent chromatin modification | ARID1A, ASF1A, ASF1B, BAF53A, BRCA2, CHD4, EHMT1, GCN5L2, HDAC9, HELSNF1, HMG20B, MLL3, MLL4, MSL3L1, SETDB1, SIRT7,SMARCA1 , SMARCA5, SMARCAD1, SMARCC2, SMARCD1 |

FIGURE 7

| Gene | Accession Number | Sequence | Product Size (bp) |
|---|---|---|---|
| OCT4 | NM_002701 | 5'-GAGTGAGAGGCAACCTGGAG-3'<br>5'-GTGAAGTGAGGGCTCCCATA-3' | 274 |
| STELLA | AY317075 | 5'-CTCAAATCTCCTCCGAGACG-3'<br>5'-TGAAGTGGCTTGGTGTCTTG-3' | 385 |
| ESG1 | NM_001025290 | 5'-AGAGGTGTTCCAGGTCCAGA-3'<br>5'-GCTCTGGCCACACCTAATC-3' | 341 |
| VASA | AY004154 | 5'-TGGGACATTCAATTCGACAA-3'<br>5'-GAGAACTGGCCAACTTGGAG-3' | 364 |
| GDF9 | NM_005260 | 5'-CTGCCTATCCTGTGGGAGAA-3'<br>5'-ACTGGAGAGCCATACCGATG-3' | 301 |
| ZP1 | NM_207341 | 5'-GGCTTCTGCAGAGGACAGAC-3'<br>5'-TCGTCGCTGTCTTGTAGTGC-3' | 344 |
| H1FOO | NM_153833 | 5'-AGTCGGGAGAGGCTAGGAAG-3'<br>5'-GTACCACCTTGGACCCACTG-3' | 306 |
| CDH3 | NM_001793 | 5'-GCTACCGCATCCTGAGAGAC-3'<br>5'-TCACCTTCCTCGTTGACCTC-3' | 376 |
| TUB4Q | U83110 | 5'-CTGGTGTCTGCTACCGTGAG-3'<br>5'-GGGAGCCAGTCAGCAAAGTA-3' | 356 |
| ACTB | NM_001101 | 5'-GGCATCCTCACCCTGAAGTA-3'<br>5'-CCATCTCTTGCTCGAAGTCC-3' | 496 |

FIGURE 8

| Gene title | Gene symbol | Reported function(s) in murine oocytes | Reference |
|---|---|---|---|
| developmental pluripotency associated 3 | DPPA3 | Maternal effect gene required for oocyte development | Curr Biol, 2003, 13:2110-7 |
| zona pellucida glycoprotein 1 (sperm receptor); zona pellucida glycoprotein 3 (sperm receptor) | ZP1, ZP3 | Required for successful fertilization in which the sperm must bind and penetrate the ZP; prevention of further sperm entry following fertilization; and prevents blastocyst adherence to oviduct wall as it travels down the uterus | Front Biosci., 2005, 10:2335-45 |
| v-mos Moloney murine sarcoma viral oncogene homolog | MOS | Activation of MAPK cascade that enables progression through oocyte maturation, and subsequent maintenance of meiotic metaphase II arrest | Biochem Biophys Res Commun., 2002, 296:1372-7 |
| growth differentiation factor 9 | GDF9 | Essential for ovarian follicular growth and function | Cell Tissue Res., 2005, 322:107-15; Reproduction, 2005, 129:473-80 |
| centromere protein A, 17kDa; centromere protein E, 312kDa | CENPA, CENPE | A component of meiotic kinetochores required for meiosis I | Proc Natl Acad Sci USA, 1997, 94:9165-70; Chromosoma, 1988, 96:341-52 |
| BUB1 budding uninhibited by benzimidazoles 1 homolog beta (yeast) | BUB1B | Contribute to meiotic metaphase II arrest independent of spindle checkpoint activation | Reproduction, 2003, 126:443-50 |
| maternal embryonic leucine zipper kinase | MELK | May play a role in regulatory signal transduction pathways in oocyte | Mol Reprod Dev., 1997, 47:148-56 |
| BCL2-like 10 (apoptosis facilitator) | BCL2L10 | A component of the Bcl2 protein family important for the activation of a pro-apoptotic signalling pathway in ageing oocytes | Biol Reprod., 2005, [Epub ahead of print] |
| cyclin B1 | CCNB11 | Interacts with the cdc2 protein kinase to form the maturation promoting factor essential of oocyte maturation and arrest | Biol Reprod., 1997, 56:253-9 |
| cyclin A2 | CCNA2 | Distinct roles in both mitosis and meiosis based on expression and localization changes in oocytes from embryonic stages to post-natal and adult ovaries | Reproduction, 2005, 130:411-22 |
| aurora kinase B; aurora kinase C | AURKB, AURKC | Meiotic prophase I reactivation via the polyadenylation of specific transcripts such as Mos serine/threonine kinase | Biol Cell, 2004, 96:215-29 |
| DNA (cytosine-5-)-methyltransferase 1; DNA (cytosine-5-)-methyltransferase 3 beta | DNMT1, DNMT3b* | Maintenance methylation of imprinted alleles in oocyte and pre-implantation embryos | Dev Dyn., 2005, 232:992-1002; Dev Biol., 2002, 245:304-14; Mol Reprod Dev., 2002, 63:269-72 |

*DNMT3b is ranked within the top 200 genes

| Gene Symbol | Gene Title | FC (hOoc) | FC (hESC) |
|---|---|---|---|
| PDK1 | pyruvate dehydrogenase kinase, isoenzyme 1 | 65.81 | 6.96 |
| POU5F1 | POU domain, class 5, transcription factor 1 | 6.75 | 5.67 |
| JARID2 | Jumonji, AT rich interactive domain 2 | 48.31 | 5.05 |
| MSH2 | mutS homolog 2, colon cancer, nonpolyposis type 1 (E. coli) | 44.93 | 3.93 |
| DNMT3B | DNA (cytosine-5-)-methyltransferase 3 beta | 42.64 | 3.45 |
| PTTG1 | pituitary tumor-transforming 1 | 127.7 | 3.33 |
| CDT1 | DNA replication factor | 5.87 | 3.24 |
| KIF2C | kinesin family member 2C | 10.53 | 3.15 |
| BUB1 | BUB1 budding uninhibited by benzimidazoles 1 homolog (yeast) | 39.85 | 3.05 |
| ORC1L | origin recognition complex, subunit 1-like (yeast) | 37.76 | 2.99 |
| BIRC5 | baculoviral IAP repeat-containing 5 (survivin) | 3.09 | 2.92 |
| UNG | uracil-DNA glycosylase | 20.81 | 2.88 |
| CCNA2 | cyclin A2 | 224.87 | 2.77 |
| STK6 | serine/threonine kinase 6 | 188.96 | 2.76 |
| NASP | nuclear autoantigenic sperm protein (histone-binding) | 7.4 | 2.68 |
| CCNB1 | cyclin B1 | 138.32 | 2.66 |
| MCM7 | MCM7 minichromosome maintenance deficient 7 (S. cerevisiae) | 5.13 | 2.63 |
| CHEK1 | CHK1 checkpoint homolog (S. pombe) | 48.59 | 2.52 |
| CENPA | centromere protein A, 17kDa | 527.02 | 2.48 |
| PRIM2A | primase, polypeptide 2A, 58kDa | 8.9 | 2.42 |
| C10orf86 | chromosome 10 open reading frame 86 | 21.37 | 2.31 |
| EXOSC7 | exosome component 7 | 15.45 | 2.26 |
| AKAP1 | A kinase (PRKA) anchor protein 1 | 34.31 | 2.25 |
| CSPG6 | chondroitin sulfate proteoglycan 6 (bamacan) | 25.77 | 2.22 |
| MAD2L1 | MAD2 mitotic arrest deficient-like 1 (yeast) | 30.33 | 2.2 |
| CCNB2 | cyclin B2 | 204.76 | 2.19 |
| USP10 | ubiquitin specific peptidase 10 | 3.26 | 2.1 |
| PIAS2 | protein inhibitor of activated STAT, 2 | 5.2 | 2.09 |
| ASPM | asp (abnormal spindle)-like, microcephaly associated (Drosophila) | 836.86 | 2.08 |
| POLE2 | polymerase (DNA directed), epsilon 2 (p59 subunit) | 31.24 | 2.07 |
| TTK | TTK protein kinase | 194.33 | 2.07 |
| DNA2L | DNA2 DNA replication helicase 2-like (yeast) | 18.76 | 2.01 |
| ECT2 | epithelial cell transforming sequence 2 oncogene | 43.1 | 2 |
| MCM2 | MCM2 minichromosome maintenance deficient 2, mitotin (S. cerevisiae) | 71.22 | 1.98 |
| SNRPD1 | small nuclear ribonucleoprotein D1 polypeptide 16kDa | 5.2 | 1.97 |
| MCM10 | MCM10 minichromosome maintenance deficient 10 (S. cerevisiae) | 9.91 | 1.96 |
| NUP88 | nucleoporin 88kDa | 9.41 | 1.96 |
| NUP54 | nucleoporin 54kDa | 7.51 | 1.91 |
| CKS1B | CDC28 protein kinase regulatory subunit 1B | 27.18 | 1.88 |
| SAP30 | sin3-associated polypeptide, 30kDa | 9.71 | 1.87 |
| FLJ20364 | hypothetical protein FLJ20364 | 25.52 | 1.82 |
| SART3 | squamous cell carcinoma antigen recognised by T cells 3 | 15.78 | 1.82 |

| Gene | Description | Value 1 | Value 2 |
|---|---|---|---|
| HSPA14 | heat shock 70kDa protein 14 | 13.69 | 1.82 |
| HMGB2 | high-mobility group box 2 | 6.08 | 1.81 |
| DCLRE1A | DNA cross-link repair 1A (PSO2 homolog, S. cerevisiae) | 41.63 | 1.75 |
| TCL1A | T-cell leukemia/lymphoma 1A | 118.95 | 1.75 |
| RRM2 | ribonucleotide reductase M2 polypeptide | 73.43 | 1.75 |
| ASF1A | ASF1 anti-silencing function 1 homolog A (S. cerevisiae) | 56.65 | 1.75 |
| C14orf94 | chromosome 14 open reading frame 94 | 27.15 | 1.75 |
| GMNN | geminin, DNA replication inhibitor | 14.18 | 1.74 |
| PLK1 | polo-like kinase 1 (Drosophila) | 9.03 | 1.73 |
| FLJ11305 | hypothetical protein FLJ11305 | 25.08 | 1.71 |
| BLM | Bloom syndrome | 12.51 | 1.68 |
| SMN1 | survival of motor neuron 1, telomeric | 7.99 | 1.66 |
| CDCA3 | cell division cycle associated 3 | 27.59 | 1.65 |
| NUP93 | nucleoporin 93kDa | 11.92 | 1.63 |
| TRIP13 | thyroid hormone receptor interactor 13 | 43.14 | 1.55 |
| ORC6L | origin recognition complex, subunit 6 homolog-like (yeast) | 59.73 | 1.52 |
| NUP107 | nucleoporin 107kDa | 19.41 | 1.52 |
| TCOF1 | Treacher Collins-Franceschetti syndrome 1 | 21.64 | 1.51 |
| TCERG1 | transcription elongation regulator 1 | 3.71 | 1.51 |
| MCM4 | MCM4 minichromosome maintenance deficient 4 (S. cerevisiae) | 6.14 | 1.5 |
| NAP1L1 | nucleosome assembly protein 1-like 1 | 3.18 | 1.48 |
| MRPL18 | mitochondrial ribosomal protein L18 | 8.8 | 1.46 |
| DHFR | dihydrofolate reductase | 85.24 | 1.45 |
| MAPKAPK5 | mitogen-activated protein kinase-activated protein kinase 5 | 3.43 | 1.45 |

FIGURE 18

| GO Biological Process | No. of Genes | P Value | GO Molecular function | No. of Genes | P Value |
|---|---|---|---|---|---|
| Development | 249 | 1.88E-08 | Metal ion binding | 413 | 4.75E-06 |
| Cell proliferation | 86 | 4.57E-06 | RNA binding | 83 | 1.37E-05 |
| Cell differentiation | 80 | 1.47E-05 | GTPase regulator activity | 48 | 7.10E-05 |
| Nervous system development | 74 | 4.68E-05 | Hydrolase activity, acting on acid anhydrides | 83 | 3.65E-04 |
| System development | 74 | 6.15E-05 | Catalytic activity | 592 | 9.86E-04 |
| Cell communication | 400 | 6.53E-05 | Magnesium ion binding | 43 | 0.001518 |
| Cellular process | 1310 | 1.41E-04 | Enzyme regulator activity | 85 | 0.002361 |
| Regulation of cellular physiological process | 382 | 2.21E-04 | Calcium ion binding | 109 | 0.002456 |
| Signal transduction | 365 | 3.32E-04 | ATPase activity, coupled | 44 | 0.002512 |
| Organ development | 77 | 4.08E-04 | Transcription regulator activity | 158 | 0.002288 |

FIGURE 19(1)

| Gene Title | Gene Symbol | NCBI Accession No | Sequence |
|---|---|---|---|
| Homo sapiens protein arginine methyltransferase 5 (PRMT5), transcript variant 1 | PRMT5 | NM_006109 | GCGACTCGTCCCGCCTTCTGGGGCACTAGTTT GACTTTGTGATTGGCTACTAGTATCAAGGAAT CCCGGCGTGGACAGCGCGAGGAGAAAGATGGC GGCGATGGCGGTCGGGGGTGCTGGTGGGAGCC GCGTGTCCAGCGGGAGGGACCTGAATTGCGTC CCCGAAATAGCTGACACACTAGGGGCTGTGGC CAAGCAGGGGTTTGATTTCCTCTGCATGCCTG TCTTCCATCCGCGTTTCAAGAGGGAGTTCATT CAGGAACCTGCTAAGAATCGGCCCGGTCCCCA GACACGATCAGACCTACTGCTGTCAGGAAGGG ACTGGAATACGCTAATTGTGGGAAAGCTTTCT CCATGGATTCGTCCAGACTCAAAAGTGGAGAA GATTCGCAGGAACTCCGAGGCGGCCATGTTAC AGGAGCTGAATTTTGGTGCATATTTGGGTCTT CCAGCTTTCCTGCTGCCCCTTAATCAGGAAGA TAACACCAACCTGGCCAGAGTTTTGACCAACC ACATCCACACTGGCCATCACTCTTCCATGTTC TGGATGCGGGTACCCTTGGTGGCACCAGAGGA CCTGAGAGATGATATAATTGAGAATGCACCAA CTACACACACAGAGGAGTACAGTGGGGAGGAG AAAACGTGGATGTGGTGGCACAACTTCCGGAC TTTGTGTGACTATAGTAAGAGGATTGCAGTGG CTCTTGAAATTGGGGCTGACCTCCCATCTAAT CATGTCATTGATCGCTGGCTTGGGGAGCCCAT CAAAGCAGCCATTCTCCCCACTAGCATTTTCC TGACCAATAAGAAGGGATTTCCTGTTCTTTCT AAGATGCACCAGAGGCTCATCTTCCGGCTCCT CAAGTTGGAGGTGCAGTTCATCATCACAGGCA CCAACCACCACTCAGAGAAGGAGTTCTGCTCC TACCTCCAATACCTGGAATACTTAAGCCAGAA CCGTCCTCCACCTAATGCCTATGAACTCTTTG CCAAGGGCTATGAAGACTATCTGCAGTCCCCG CTTCAGCCACTGATGGACAATCTGGAATCTCA GACATATGAAGTGTTTGAAAAGGACCCCATCA AATACTCTCAGTACCAGCAGGCCATCTATAAA TGTCTGCTAGACCGAGTACCAGAAGAGGAGAA GGATACCAATGTCCAGGTACTGATGGTGCTGG GAGCAGGACGGGGACCCCTGGTGAACGCTTCC CTGCGGGCAGCCAAGCAGGCCGACCGGCGGAT AAAGCTGTATGCTGTGGAGAAAAACCCAAATG CCGTGGTGACGCTAGAGAACTGGCAGTTTGAA GAATGGGGAAGCCAAGTGACCGTAGTCTCATC AGACATGAGGGAATGGGTGGCTCCAGAGAAAG CAGACATCATTGTCAGTGAGCTTCTGGGCTCA |

FIGURE 19(2)

| | | | |
|---|---|---|---|
| | | | TTTGCTGACAATGAATTGTCGCCTGAGTGCCT<br>GGATGGAGCCCAGCACTTCCTAAAAGATGATG<br>GTGTGAGCATCCCCGGGGAGTACACTTCCTTT<br>CTGGCTCCCATCTCTTCCTCCAAGCTGTACAA<br>TGAGGTCCGAGCCTGTAGGGAGAAGGACCGTG<br>ACCCTGAGGCCCAGTTTGAGATGCCTTATGTG<br>GTACGGCTGCACAACTTCCACCAGCTCTCTGC<br>ACCCCAGCCCTGTTTCACCTTCAGCCATCCCA<br>ACAGAGATCCTATGATTGACAACAACCGCTAT<br>TGCACCTTGGAATTTCCTGTGGAGGTGAACAC<br>AGTACTACATGGCTTTGCCGGCTACTTTGAGA<br>CTGTGCTTTATCAGGACATCACTCTGAGTATC<br>CGTCCAGAGACTCACTCTCCTGGGATGTTCTC<br>ATGGTTTCCCATCCTCTTCCCTATTAAGCAGC<br>CCATAACGGTACGTGAAGGCCAAACCATCTGT<br>GTGCGTTTCTGGCGATGCAGCAATTCCAAGAA<br>GGTGTGGTATGAGTGGGCTGTGACAGCACCAG<br>TCTGTTCTGCTATTCATAACCCCACAGGCCGC<br>TCATATACCATTGGCCTCTAGCCCTGCGTGCC<br>AAGTGTCCAGAGCCTTGGAAGCAGCTTCAGGT<br>TCTGCTCCTGTAGTACAGAAGGTGCAGTACAT<br>CTATGGGCTGTGATTCCCCTTGCCCATCAGAG<br>AGGAGCATTTCAATCTGCTTTCCTGCCTTACA<br>TCAAGGTGGGCAAGGGATTATAATTAATTGCA<br>GGGCTCAAGCCACCAATCTATGAAGACCTCAG<br>GCCAGGGGTGAGGAATTAGTGCTGGATTTGA<br>AGCTACGCACTCAGCCTCAAGAACTCCCTGGA<br>ATATCCCTGAGAACATGGGGTTTGAACGGATT<br>TTCAGCCTTTTTCTGTTCTTGTTTTGATGGTT<br>TTGTGTAAGAGGAAATACAAATAAAGTTATAG<br>CCCTTTACTGCACGACC |
| Homo sapiens protein arginine methyltransferase 5 (PRMT5),transcript variant 2 | PRMT5 | NM_001039619 | GCGACTCGTCCCGCCTTCTGGGGCACTAGT<br>TTGACTTTGTGATTGGCTACTAGTATCAAG<br>GAATCCCGGCGTGGACAGCGCGAGGAGAAA<br>GATGGCGGCGATGGCGGTCGGGGGTGCTGG<br>TGGGAGCCGCGTGTCCAGCGGGAGGGACCT<br>GAATTGCGTCCCCGAAATAGCTGACACACT<br>AGGGGCTGTGGCCAAGCAGGGGTGAGGGCC<br>GGACCTCCACGAGCGGAATGCGGGGTCCGA<br>ACTCGGGGACGGAGAAGGGCAGACTAGTCA<br>TCCCGGAGAAGCAGGGGTTTGATTTCCTCT<br>GCATGCCTGTCTTCCATCCGCGTTTCAAGA<br>GGGAGTTCATTCAGGAACCTGCTAAGAATC<br>GGCCCGGTCCCCAGACACGATCAGACCTAC |

FIGURE 19(3)

| | | | |
|---|---|---|---|
| | | | TGCTGTCAGGAAGGGACTGGAATACGCTAA |
| | | | TTGTGGGAAAGCTTTCTCCATGGATTCGTC |
| | | | CAGACTCAAAAGTGGAGAAGATTCGCAGGA |
| | | | ACTCCGAGGCGGCCATGTTACAGGAGCTGA |
| | | | ATTTTGGTGCATATTTGGGTCTTCCAGCTT |
| | | | TCCTGCTGCCCCTTAATCAGGAAGATAACA |
| | | | CCAACCTGGCCAGAGTTTTGACCAACCACA |
| | | | TCCACACTGGCCATCACTCTTCCATGTTCT |
| | | | GGATGCGGGTACCCTTGGTGGCACCAGAGG |
| | | | ACCTGAGAGATGATATAATTGAGAATGCAC |
| | | | CAACTACACACACAGAGGAGTACAGTGGGG |
| | | | AGGAGAAAACGTGGATGTGGTGGCACAACT |
| | | | TCCGGACTTTGTGTGACTATAGTAAGAGGA |
| | | | TTGCAGTGGCTCTTGAAATTGGGGCTGACC |
| | | | TCCCATCTAATCATGTCATTGATCGCTGGC |
| | | | TTGGGGAGCCCATCAAAGCAGCCATTCTCC |
| | | | CCACTAGCATTTTCCTGACCAATAAGAAGG |
| | | | GATTTCCTGTTCTTTCTAAGATGCACCAGA |
| | | | GGCTCATCTTCCGGCTCCTCAAGTTGGAGG |
| | | | TGCAGTTCATCATCACAGGCACCAACCACC |
| | | | ACTCAGAGAAGGAGTTCTGCTCCTACCTCC |
| | | | AATACCTGGAATACTTAAGCCAGAACCGTC |
| | | | CTCCACCTAATGCCTATGAACTCTTTGCCA |
| | | | AGGGCTATGAAGACTATCTGCAGTCCCCGC |
| | | | TTCAGCCACTGATGGACAATCTGGAATCTC |
| | | | AGACATATGAAGTGTTTGAAAAGGACCCCA |
| | | | TCAAATACTCTCAGTACCAGCAGGCCATCT |
| | | | ATAAATGTCTGCTAGACCGAGTACCAGAAG |
| | | | AGGAGAAGGATACCAATGTCCAGGTACTGA |
| | | | TGGTGCTGGGAGCAGGACGGGGACCCCTGG |
| | | | TGAACGCTTCCCTGCGGGCAGCCAAGCAGG |
| | | | CCGACCGGCGGATAAAGCTGTATGCTGTGG |
| | | | AGAAAAACCCAAATGCCGTGGTGACGCTAG |
| | | | AGAACTGGCAGTTTGAAGAATGGGGAAGCC |
| | | | AAGTGACCGTAGTCTCATCAGACATGAGGG |
| | | | AATGGGTGGCTCCAGAGAAAGCAGACATCA |
| | | | TTGTCAGTGAGCTTCTGGGCTCATTTGCTG |
| | | | ACAATGAATTGTCGCCTGAGTGCCTGGATG |
| | | | GAGCCCAGCACTTCCTAAAAGATGATGGTG |
| | | | TGAGCATCCCCGGGGAGTACACTTCCTTTC |
| | | | TGGCTCCCATCTCTTCCTCCAAGCTGTACA |
| | | | ATGAGGTCCGAGCCTGTAGGGAGAAGGACC |
| | | | GTGACCCTGAGGCCCAGTTTGAGATGCCTT |
| | | | ATGTGGTACGGCTGCACAACTTCCACCAGC |

FIGURE 19(4)

| | | | |
|---|---|---|---|
| | | | TCTCTGCACCCCAGCCCTGTTTCACCTTCA GCCATCCCAACAGAGATCCTATGATTGACA ACAACCGCTATTGCACCTTGGAATTTCCTG TGGAGGTGAACACAGTACTACATGGCTTTG CCGGCTACTTTGAGACTGTGCTTTATCAGG ACATCACTCTGAGTATCCGTCCAGAGACTC ACTCTCCTGGGATGTTCTCATGGTTTCCCA TCCTCTTCCCTATTAAGCAGCCCATAACGG TACGTGAAGGCCAAACCATCTGTGTGCGTT TCTGGCGATGCAGCAATTCCAAGAAGGTGT GGTATGAGTGGGCTGTGACAGCACCAGTCT GTTCTGCTATTCATAACCCCACAGGCCGCT CATATACCATTGGCCTCTAGCCCTGCGTGC CAAGTGTCCAGAGCCTTGGAAGCAGCTTCA GGTTCTGCTCCTGTAGTACAGAAGGTGCAG TACATCTATGGGCTGTGATTCCCCTTGCCC ATCAGAGAGGAGCATTTCAATCTGCTTTCC TGCCTTACATCAAGGTGGGCAAGGGATTAT AATTAATTGCAGGGCTCAAGCCACCAATCT ATGAAGACCTCAGGCAGGGGTGAGGAAT TAGTGCTGGATTTGAAGCTACGCACTCAGC CTCAAGAACTCCCTGGAATATCCCTGAGAA CATGGGGTTTGAACGGATTTTCAGCCTTTT TCTGTTCTTGTTTTGATGGTTTTGTGTAAG AGGAAATACAAATAAAGTTATAGCCCTTTA CTGCACGACC |
| Homo sapiens cDNA clone IMAGE:5299642 | | BC041913 | TAATTCAGAATTGAGTAAAGAAATATTTTTC TAGTCCTTCATATATTGAAAACTTGCCACATG ACATTGTATCGTCTTCATTTTCCAGAAGATGC GTTGGTGTGCCATAGGTTTCTAACTTCCTTGA AAATAGTTTTTTAAGTCAATTGTAAATATACG TATTATTGTTAAAAGTAACTTTAAACTGCAAC ACATAGCTTCAAAACAATATAGAGATTTTGTA ATACCTTATAAGTGGAGTTGGCTAAAATACCT TATCCATATAAAACTTATTCTATTCTTTGCAT GCTTATTTTGTGTGTTGGTTGCTAGCTTAAAG TTTGATTTGTTGTTACTCTTTGTGTGCCAAAT TCACTAGGCAAGCGGATTTTTCCTCAGACTTC AAAAAATAATTCTTTTAAGAAAAAATGTAAAA ATGTTTATTCTAAAAAGCTGCATTAAAGGGAC AACCTATAAAAAGTTTTGCTAGCTCATCTTTA GAAGGAAGAAAGAATATTAGCTTGGGTGATGT TTAATTTGGGTGGCGATAGTTTCTGTAGGCTA AACTTTATGAGAAAAGTGTACCTACTCTATAA |

FIGURE 19(5)

| | | | |
|---|---|---|---|
| | | | AGGTAATAAATGTAAAACCTCTTGCTGTTATT GAGGAAGCTCTTCAACTACCCTAAATTTCACA AATGTAACTTATAACACTATGAAAAGATTTGA CCAACAATTTACGTTTGCTGTGTGCTTTAGTT TTTGTTTAAGCATATTCTTTTGCTTGAATTTC TGTGTTCATGAGAGTTAGGGTGTTTTATGCTT CTTGAACTAATTTTATAACATATTTAATATAT TACCAGTTAAGATATAAAATCATTTGTACATA GCGAATTGTAAAGCAGCTATTAAAGTAGGTGA AATAAAGTATATATTTGCCGGTTATCCATATC TTTTAGAAGTCCTGACAGAACAACCAGTTTAT TTGCACATAGGTAGCTTCTGTTTGAAGGAAGG TAAAGTTATAAGGAAACTCAAATACTATAAGA TGTGTCAAGGTATTTCTCCAGAATTAATTGCA AAGCTAGTGCTGAAGGATTTTAATCAGCTTCT AAAATTTTCTTCTCAATAAGACATATGTTTTG ATTACTTAGGGAAGATTCCTCATTTTTATTTG CCCTTTATGCATTTAATCCACATGATAGGACA TTAAAAATTAATATAAAGAAAAATCGTGCTCA TACTGTACATCTATTTCTGTGCTTGGAACTAC TTGTTAATAGTTTTTATCGAAGCTGTCAGCAA TAAGGGACATAAAACTGCTGTATTATACATTG TGGAATTGAATAAACAGCCTAATTTTTTTTT TCTAGTATAGGGTACTTAAGCATTTCCACTTT TGGAAGAAAAGTGTATTAGTATTTTATATTGC ATTTCATTTAAAAGGACAGTTTTTTTTTTTT TGTAAATCCATTCATTGAAATGGTTTCTAAAC TGTATAATGTAATTTGGAGCCTATTTAGTAAT AGAATTAAATGTCCTATGTAGTGCTACAATTT TTGAATTAGAAAGTGATCAAATGTAAGAAAAA AATTTAAAAATTCAGCCCAGAAAACAAAATAG TGTATTAAATTAGTTTAATGTAAAAGGAATTT ATAAGATTTTTTCCTCAATATAGATACCTCA CTTGAAAAGAAAGCACAGCATACTTAAAGTAG TTCTAGTAAACATGTCCTAGAAAACAGTTGCT AAATGTAGGACATCTTTTGAGGAATTAGTTTA TGAGAAATAAAATTTTACTTGTTTTTACTATC CTGTTAGAAGTATTTGTTTATCCTGATAATTT TAAGCCAACATAGTAGTCTTAAATTACTTTTG AATTTCTAATCTGTGAAGGCAGTAAATGAAAT ATCTGTTCTGCAACTGTTGAAACAAATAATTG GCTACATTGACCATAATTAAAGTTAAAATTTT GCCAATGATGTACAGTTTTATGGTTAAAGTTG CTGTGGTTGGTTGCATTACATGACACAGAAAA |

FIGURE 19(6)

| | | | |
|---|---|---|---|
| | | | CTGTCCTCTACCTCACGTGAAATAAATATTTT ATATGGTTTTACTAAAAATAAGACTCATGTAT CTGGTCACCTAGTTTACAAATTTTGAATTATA TTTATTGAAACATGACATACTGTGCTCTGAGC TTATACCTCAATTGTATTTTGTGCTGTTTTCC ATTTTCATGCCTTGTAAATAACTTGTATAGAT TGTGGATCAAATACTAAATAAAAACTTTTAAT GCCAAAAAAAAAAAAAAAA |
| Homo sapiens BTG family, member 2 (BTG2) | BTG2 | NM_006763 | CAGGGTAACGCTGTCTTGTGGACCCGCACT TCCCACCCGAGACCTCTCACTGAGCCCGAG CCGCGCGCGACATGAGCCACGGGAAGGGAA CCGACATGCTCCCGGAGATCGCCGCCGCCG TGGGCTTCCTCTCCAGCCTCCTGAGGACCC GGGGCTGCGTGAGCGAGCAGAGGCTTAAGG TCTTCAGCGGGGCGCTCCAGGAGGCACTCA CAGAGCACTACAAACACCACTGGTTTCCCG AAAAGCCGTCCAAGGGCTCCGGCTACCGCT GCATTCGCATCAACCACAAGATGGACCCCA TCATCAGCAGGGTGGCCAGCCAGATCGGAC TCAGCCAGCCCCAGCTGCACCAGCTGCTGC CCAGCGAGCTGACCCTGTGGGTGGACCCCT ATGAGGTGTCCTACCGCATTGGGGAGGACG GCTCCATCTGCGTCTTGTACGAGGAGGCCC CACTGGCCGCCTCCTGTGGGCTCCTCACCT GCAAGAACCAAGTGCTGCTGGGCCGGAGCA GCCCCTCCAAGAACTACGTGATGGCAGTCT CCAGCTAGGCCCTTCCGCCCCCGCCCTGGG CGCCGCCGTGCTCATGCTGCCGTGACAACA GGCCACCACATACCTCAACCTGGGGAACTG TATTTTTAAATGAAGAGCTATTTATATATA TTATTTTTTTTAAGAAAGGAGGAAAAGAA ACCAAAAGTTTTTTTTAAGAAAAAAAATCC TTCAAGGGAGCTGCTTGGAAGTGGCCTCCC CAGGTGCCTTTGGAGAGAACTGTTGCGTGC TTGAGTCTGTGAGCCAGTGTCTGCCTATAG GAGGGGGAGCTGTTAGGGGGTAGACCTAGC CAAGGAGAAGTGGGAGACGTTTGGCTAGCA CCCCAGGAAGATGTGAGAGGGAGCAAGCAA GGTTAGCAACTGTGAACAGAGAGGTCGGGA TTTGCCCTGGGGGAGGAAGAGAGGCCAAGT TCAGAGCTCTCTGTCTCCCCCAGCCAGACA CCTGCATCCCTGGCTCCTCTATTACTCAGG GGCATTCATGCCTGGACTTAAACAATACTA TGTTATCTTTTCTTTTATTTTTCTAATGAG |

FIGURE 19(7)

```
GTCCTGGGCAGAGAGTGAAAAGGCCTCTCC
TGATTCCTACTGTCCTAAGCTGCTTTTCTT
GAAATCATGACTTGTTTCTAATTCTACCCT
CAGGGGCCTGTAGATGTTGCTTTCCAGCCA
GGAATCTAAAGCTTTGGGTTTTCTGAGGGG
GGGGAGGAGGGAACTGGAGGTTATTGGGGT
TAGGATGGAAGGGAACTCTGCACAAAACCT
TTGCTTTGCTAGTGCTGCTTTGTGTGTATG
TGTGGCAAATAATTTGGGGGTGATTTGCAA
TGAAATTTTGGGACCCAAAGAGTATCCACT
GGGGATGTTTTTTGGCCAAAACTCTTCCTT
TTGGAACCACATGAAAGTCTTGATGCTGCT
GCCATGATCCCTTTGAGAGGTGGCTCAAAA
GCTACAGGGAACTCCAGGTCCTTTATTACT
GCCTTCTTTTCAAAAGCACAACTCTCCTCT
AACCCTCCCCTCCCCCTTCCCTTCTGGTCG
GGTCATAGAGCTACCGTATTTTCTAGGACA
AGAGTTCTCAGTCACTGTGCAATATGCCCC
CTGGGTCCCAGGAGGGTCTGGAGGAAAACT
GGCTATCAGAACCTCCTGATGCCCTGGTGG
GCTTAGGGAACCATCTCTCCTGCTCTCCTT
GGGATGATGGCTGGCTAGTCAGCCTTGCAT
GTATTCCTTGGCTGAATGGGAGAGTGCCCC
ATGTTCTGCAAGACTACTTGGTATTCTTGT
AGGGCCGACACTAAATAAAAGCCAAACCTT
GGGCACTGTTTTTTCTCCCTGGTGCTCAGA
GCACCTGTGGGAAAGGTTGCTGTCTGTCTC
AGTACAATCCAAATTTGTCGTAGACTTGTG
CAATATATACTGTTGTGGGTTGGAGAAAAG
TGGAAAGCTACACTGGGAAGAAACTCCCTT
CCTTCAATTTCTCAGTGACATTGATGAGGG
GTCCTCAAAAGACCTCGAGTTTCCCAAACC
GAATCACCTTAAGAAGGACAGGGCTAGGGC
ATTTGGCCAGGATGGCCACCCTCCTGCTGT
TGCCCCTTAGTGAGGAATCTTCACCCCACT
TCCTCTACCCCCAGGTTCTCCTCCCCACAG
CCAGTCCCCTTTCCTGGATTTCTAAACTGC
TCAATTTTGACTCAAAGGTGCTATTTACCA
AACACTCTCCCTACCCATTCCTGCCAGCTC
TGCCTCCTTTTCAACTCTCCACATTTTGTA
TTGCCTTCCCAGACCTGCTTCCAGTCTTTA
TTGCTTTAAAGTTCACTTTGGGCCCACAGA
CCCAAGAGCTAATTTTCTGGTTTGTGGGTT
GAAACAAAGCTGTGAATCACTGCAGGCTGT
```

FIGURE 19(8)

| | | | |
|---|---|---|---|
| | | | GTTCTTGCATCTTGTCTGCAAACAGGTCCC TGCCTTTTTAGAAGCAGCCTCATGGTCTCA TGCTTAATCTTGTCTCTCTTCTCTTCTTTA TGATGTTCACTTTAAAAACAACAAAACCCC TGAGCTGGACTGTTGAGCAGGCCTGTCTCT CCTATTAAGTAAAAATAAATAGTAGTAGTA TGTTTGTAAGCTATTCTGACAGAAAAGACA AAGGTTACTAATTGTATGATAGTGTTTTTA TATGGAAGAATGTACAGCTTATGGACAAAT GTACACCTTTTTGTTACTTTAATAAAAATG TAGTAGGATAAAAAAAAA |

IDENTIFICATION OF GENES OR POLYPEPTIDES THE EXPRESSION OF WHICH CORRELATES TO FERTILITY, OVARIAN FUNCTION AND/OR FETAL/NEWBORN VIABILITY

CROSS REFERENCE TO RELATED APPLICATIONS

This application is a continuation in part of U.S. Ser. No. 11/437,797 filed on May 22, 2006, which is in turn a continuation-in-part of U.S. Ser. No. 11/091,883 filed on Mar. 29, 2005. This application further claims the benefit of provisional application No. 60/556,875 filed Mar. 29, 2004. All of these applications are incorporated herein by reference in their entirety.

SEQUENCE LISTING

The instant application contains a "lengthy" Sequence Listing which has been submitted via CD-R in lieu of a printed paper copy, and is hereby incorporated by reference in its entirety. Said CD-R, recorded on Jan. 15, 2007, are labeled CRF, "Copy 1" and "Copy 2", respectively, and each contains only one identical 1.62 MB file (67839435.APP).

FIELD OF THE INVENTION

The present invention provides genetic methods that provide for the identification of "pregnancy competent" oocytes, i.e., oocytes that when fertilized and transferred to a suitable uterine environment are capable of yielding a viable pregnancy. The present invention further provides genetic methods of identifying female subjects, preferably human females having impaired fertility function, e.g., as a result of impaired ovarian function, e.g., as a result of age (menopause) or an underlying disease condition or therapy.

Also, the invention provides methods of evaluating the efficacy of a putative fertility treatment based on its effect on the expression of specific genes.

Further, the invention identifies genes which are differentially expressed by cumulus cells that correlate to the pregnancy potential of oocytes that are associated therewith.

Further, the present invention provides an improved mRNA amplification protocol that is especially suited for gene expression profiling of biological samples of small quantity, such as cumulus or stem cell containing cell samples.

BACKGROUND OF THE INVENTION

Currently, there is no available genetic procedures for identifying whether a female subject produces oocytes that are "pregnancy competent", i.e., oocytes which when fertilized by natural or artificial means are capable of giving rise to embryos that in turn are capable of yielding viable offspring when transferred to an appropriate uterine environment. Rather, conventional fertility assessment methods assess fertility e.g., based on hormonal levels, visual inspection of numbers and quality of oocytes, surgical or non-invasive (MRI) inspection of the female reproduction system organs, and the like. Often, when a woman has a problem in producing a viable pregnancy after a prolonged duration, e.g., more than a year, the diagnosis may be an "unexplained" fertility problem and the woman advised to simply keep trying or to seek other options, e.g., adoption or surrogacy. Therefore, providing alternative and more predictive methods for identifying women with fertility problems would be highly desirable. Likewise, novel and improved methods for treating fertility problems would be highly desirable.

Still further, the identification of women with fertility problems, preferably earlier on than by current methods is desirable, as fertility problems may correlate to other health issues that preclude pregnancy, e.g., cancer, menopausal condition, hormonal dysfunction, ovarian cyst, or other underlying disease or health related problems.

BRIEF DESCRIPTION AND OBJECTS OF THE INVENTION

It is an object of the invention to provide a novel and improved method of detecting infertility problems and the genetic basis thereof It is a more specific object of the invention to provide a novel method of detecting female fertility or infertility which method comprises evaluating the capability of oocytes produced by said female to potentially give rise to a viable pregnancy upon fertilization and transferal into a suitable uterine environment, wherein said method involves detecting the levels of expression of specific ("pregnancy signature") genes or polypeptides encoded thereby by cells that are oocyte-associated, e.g., cumulus cells.

It is another specific object of the invention to provide a method of evaluating whether a subject produces oocytes capable of giving rise to a viable pregnancy comprising:

(i) measuring the expression levels of genes in a oocyte-associated cell, e.g., a cumulus cell, wherein said genes are expressed or not expressed at characteristic levels ("pregnancy signature") in cells associated with oocytes capable of yielding a viable pregnancy; and (ii) detecting the "pregnancy potential" of said oocytes based on the level of similarity of said gene expression pattern to said "pregnancy signature".

It is another specific object of the invention to identify a female subject putatively having a condition that inhibits or prevents pregnancy by detecting whether said subject produces oocytes associated with cells, e.g., cumulus cells, which do not express one or more genes in a manner characteristic of "pregnancy competent" oocytes; wherein said method comprises detecting the expression of said one or more "pregnancy signature" genes in at least one cell associated with an oocyte isolated from said female subject; and thereby identifying the subject as potentially having a health problem which prevents or precludes fertility based on an abnormal expression pattern of at least one of said "pregnancy signature" genes.

It is another object of the invention to provide a method of evaluating the efficacy of a female fertility treatment which comprises:

(i) treating a female subject putatively having a problem that prevents or inhibits her from having a "viable pregnancy" and (ii) isolating at least one oocyte from said female subject and cells associated therewith after said fertility treatment;

(iii) isolating at least one cell associated with said isolated oocyte, preferably a cumulus cell, and detecting the level of expression of at least one gene that is expressed at a characteristic level of expression in "pregnancy competent" oocytes; and (iv) determining the putative efficacy of said fertility treatment based on whether said gene is expressed at a level characteristic of "pregnancy competent" oocytes as a result of treatment.

It is another object of the invention to provide animal models for evaluating the efficacy of putative fertility treatments comprising identifying genes which are expressed at characteristic levels in cumulus cells associated with pregnancy competent oocytes of a non-human animal, e.g., a non-human primate; and assessing the efficacy of a putative fertility treatment in said non-human animal based on its effect on said gene expression levels, i.e., whether said treatment results in said gene expression levels better mimicking gene expression levels observed in cumulus cells associated with pregnancy competent oocytes, ("pregnancy signature").

It is another object of the invention to identify specific human genes that are differentially expressed by cumulus cells and other oocyte-associated cells and to assay the expression of one or more of such specific genes by cumulus or other oocyte-associated cells as an indicator of fertility and ovarian function.

It is another object of the invention to provide a novel mRNA amplification protocol especially suited for biological samples of small quantity that combines the use of specific primers, i.e., SMART II oligonucleotide (Clontech, CA) and T7-oligo(dT)24V promoter primers (Ambion, TX).

BRIEF DESCRIPTION OF THE FIGURES

FIGS. 1A-1C and 1D-1I depict schematically a genetic fertility testing method according to the invention. FIG. 1A shows a freshly ovulated egg containing a polar body, zona pellucida and cumulus cells. FIG. 1B shows the fertilization and transferal of this egg into a uterine environment. FIG. 1C shows the recovery of cumulus cells from the oocytes shown in 1A which are to be used for genetic testing. FIG. 1D-1I show the isolation of RNAs from said cumulus cells, microarray analysis of said RNAs, validation of 100 genes by real time RT-PCR, correlation of the levels of expression of said genes (upregulated or downregulated) to the ability of an oocyte to give rise to a viable pregnancy, and the use of this gene expression profile to identify a set of genes, the expression of which correlates to the capability of an oocyte to yield a viable pregnancy ("pregnancy signature")

FIG. 2 contains a flow chart of the CRL amplification protocol used in the present invention. Figure discloses SEQ ID NO: 517.

FIG. 5 contains selected overrepresented GO biological processes in oocytes identified by EASE.

FIG. 7 contains primers and sequences used to validate RT-PCR microarray experimental results (SEQ ID NOS 518-537, respectively, in order or appearance).

FIG. 8 contains selected representations of genes common to human and mouse oocytes with homologs functionally characterized in the mouse oocyte (16 genes out of top 100 genes).

FIG. 9 contains 66 unique genes in common between human oocytes, mouse oocytes, hESCs, and mESCs.

FIG. 18 contains a Table containing the top 10 functional categories overreported in differentially expressed genes between cumulus cells coming from oocytes that produce progeny and those that fail to produce progeny. Gene orthology biological properties and molecular function as detected by EASE when oocyte expressed genes were compared to the genes represented in the GeneChip array.

FIG. 19 contains the sequences of three differentially expressed genes in FIG. 17 that are expressed on average at substantially elevated amounts in cumulus cells derived from occytes that give rise to progeny versus those which do not (SEQ ID NOS 538-541, respectively, in order or appearance).

DETAILED DESCRIPTION OF THE INVENTION

Figure 3:
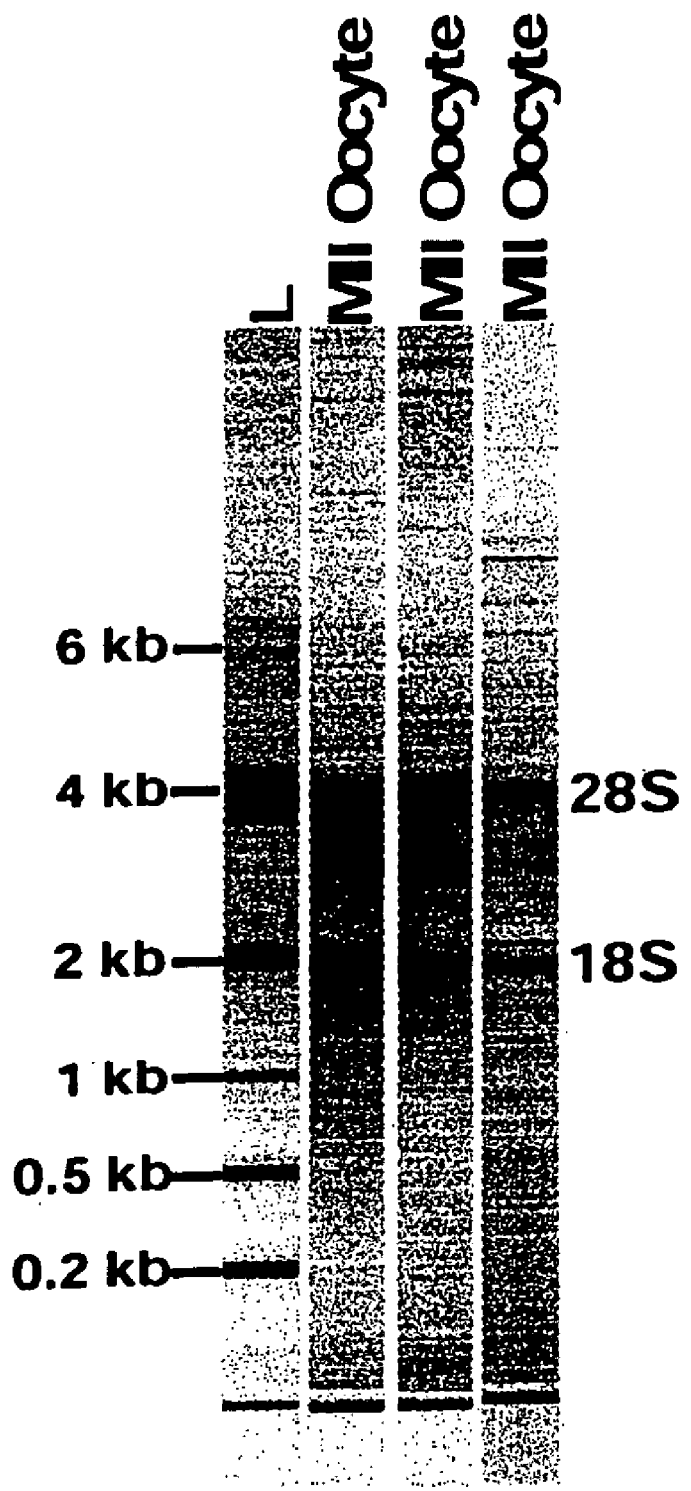
FIG. 3 contains a digital RNA gel-like image of total RNA sample isolated from 8 mature oocytes run 3 times.

Prior to discussing the invention in more detail, the following definitions are provided. Otherwise all words and phrases in this application are to be construed by their ordinary meaning, as they would be interpreted by an ordinary skilled artisan within the context of the invention.

"Pregnancy-competent oocytes": refers to a female gamete or egg that when fertilized by natural or artificial means is capable of yielding a viable pregnancy when it is comprised in a suitable uterine environment.

"Viable-pregnancy": refers to the development of a fertilized oocyte when contained in a suitable uterine environment and its development into a viable fetus, which in turn develops into a viable offspring absent a procedure or event that terminates said pregnancy.

"Cumulus cell" refers to a cell comprised in a mass of cells that surrounds an oocyte. This is an example of an "oocyte associated cell". These cells are believed to be involved in providing an oocyte some of its nutritional and or other requirements that are necessary to yield an oocyte which upon fertilization is "pregnancy competent".

"Differential gene expression" refer to genes the expression of which varies within a tissue of interest; herein preferably a cell from an oocyte, e.g., a cumulus cell.

"Real Time RT-PCR": refers to a method or device used therein that allows for the simultaneous amplification and quantification of specific RNA transcripts in a sample.

"Microarray analysis": refers to the quantification of the expression levels of specific genes in a particular sample, e.g., tissue or cell sample.

"Pregnancy signature": refers to a phrase coined by the inventors which refers to the characteristics levels of expression of a set of one or more genes, preferably at least 5, more preferably at least 10 to 20 genes, and still more preferably, at least 50 to 100 genes, that are expressed at characteristic levels in oocyte cells, preferably cumulus cells, that surround "pregnancy competent" oocytes. This is intended to encompass the level at which the gene is expressed and the distribution of gene expression within cells analyzed.

"Pregnancy signature gene": refers to a gene which is expressed at characteristic levels by a cell, e.g., cumulus cell, on a "pregnancy competent" oocyte.

"IVF": refers to in vitro fertilization.

"Zona pellucida" refers to the outermost region of an oocyte.

"Method for detecting differential expressed genes" encompasses any known method for evaluating differential gene expression. Examples include indexing differential display reverse transcription polymerase chain reaction (DDRT-PCR; Mahadeva et al., 1998, J. Mol. Biol. 284:1391-1318; WO 94/01582; subtractive mRNA hybridization (See Advanced Mol. Biol.; R. M. Twyman (1999) Bios Scientific Publishers, Oxford, p. 334, the use of nucleic acid arrays or microarrays (see Nature Genetics, 1999, vol. 21, Suppl. 1061) and the serial analysis of gene expression. (SAGE) See e.g., Valculesev et al., Science (1995) 270: 484-487) and real time PCR (RT-PCR). For example, differential levels of a transcribed gene in an oocyte cell can be detected by use of Northern blotting, and/or RT-PCR.

CRL amplification protocol refers to the novel total RNA amplification protocol depicted schematically in FIG. 2 that combines template-switching PCR and T7 based amplification methods. As noted above, this protocol is well suited for samples wherein only a few cells or limited total RNA is available.

Preferably, the "pregnancy signature" genes will be detected by hybridization of RNA or DNA to DNA chips, e.g., filter arrays comprising cDNA sequences or glass chips containing cDNA or in situ synthesized oligonucleotide sequences. Filtered arrays are typically better for high and medium abundance genes DNA chips can detect low abundance genes. In the exemplary embodiment the sample may be probed with Affymetrix GeneChips comprising genes from the human genome or a subset thereof.

Alternatively, polypeptide arrays comprising the polypeptides encoded by pregnancy signature genes or antibodies that bind thereto may be produced and used for detection and diagnosis.

"EASE" is a gene ontology protocol that from a list of genes forms subgroups based on functional categories assigned to each gene based on the probability of seeing the number of subgroup genes within a category given the frequency of genes from that category appearing on the microarray.

As noted above, the present invention preferably provides a novel method of detecting whether a female subject, human or non-human, produces "pregnancy competent" oocytes. The method involves detecting the levels of expression of one or more genes that are expressed or not expressed at characteristic levels by cumulus cells associated with (surrounding) oocytes that are "pregnancy competent", i.e., which when fertilized by natural or artificial means (IVF), and transferred into a suitable uterine environment are capable of yielding a viable pregnancy, i.e., embryo that develops into a viable fetus and eventually an offspring unless the pregnancy is terminated by some event or procedure, e.g., a surgical or hormonal intervention.

The invention further provides a novel and improved means for amplifying the total RNA from a particular cell sample that combines template-switching PCR and T7-based amplification methods (referred to herein as CRL amplification protocol). While this method is preferably used for assaying gene expression by oocyte, cumulus, or ES total RNA samples it is applicable for any cell sample, preferably a cell sample wherein amplifiable RNA is only available in small quantity.

The invention further provides transcriptome data obtained from oocyte, cumulus, or ES cells that identifies genes which are differentially expressed therein.

The invention in particular identifies 1626 genes that are differentially expressed by human ES cells.

The invention further identifies 5331 transcripts upregulated and 7074 transcripts down-regulated in human oocyte sample. Upregulated genes include FIGLA, STELLA, VASA, DAZL, GDF9, ZP1, ZP2, MOS, OCT4, NPM2, and H1FOO.

The invention further compares transcriptomes from human and mouse oocytes and identifies 1587 genes common (differentially expressed) to both.

The invention further compares the transcriptomes of oocytes and ES cells and identifies 388 (human) and 591 (mouse) genes differentially expressed in both as well as a set of 66 genes that are preferentially differentially expressed in each of human and mouse ESCs and oocytes.

In particular the invention provides a comprehensive expression baseline of gene transcripts present in in vivo matured metaphase II human oocytes.

In preferred embodiments, the inventive methods will be used to identify women subjects who produce or do not produce pregnancy competent oocytes based on the levels of expression of a set of differentially expressed genes. However, the inventive methods are applicable to non-human animals as well, e.g., other mammals, avians, amphibians, reptiles, et al. For example, the subject invention may be used to derive animal models for the study of putative female fertility treatments.

Additionally, the present invention may be used to identify female subjects who have an abnormality that precludes or inhibits their ability to produce pregnancy competent oocytes, e.g., ovarian dysfunction, ovarian cyst, pre-menopausal or menopausal condition, cancer, autoimmune disorder, hormonal dysfunction, cell proliferation disorder, or another health condition that inhibits or precludes the development of pregnancy competent oocytes.

For example, subjects who do not express specific pregnancy signature genes at characteristic expression levels will be screened to assess whether they have an underlying health condition that precludes them from producing pregnancy competent oocytes. Particularly, such subjects will be screened to assess whether they are exhibiting signs of menopause, whether they have a cancer, autoimmune disease or ovarian abnormality, e.g., ovarian cyst, or whether they have another health condition, e.g., hormonal disorder, allergic disorder, etc., that may preclude the development of "pregnancy competent" oocytes.

Additionally, the subject methods may be used to assess the efficacy of putative female fertility treatments in humans or non-human female subjects. Essentially, such methods will comprise treating a female subject, preferably a woman, with a putative fertility enhancing treatment, isolating at least one oocyte and associated surrounding cells from said woman after treatment, optionally further isolating at least one oocyte and associated surrounding cells prior to treatment, isolating at one cumulus cell from each of said isolated oocytes; detecting the levels of expression of at least one gene that is expressed or not expressed at characteristic levels by cumulus cells that are associated with (surround) pregnancy competent oocytes; and assessing the efficacy of said putative fertility treatment based on whether it results in cumulus cells that express at least one pregnancy signature gene at levels more characteristic of cumulus cells that surround pregnancy competent oocytes (than without treatment). As noted, while female human subjects are preferred, the subject methods may be used to assess the efficacy of putative fertility treatments in non-human female animals, e.g., female non-human primates or other suitable animal models for the evaluation of putative human fertility treatments.

Still further, the present invention may be used to enhance the efficacy of in vitro or in vivo fertility treatments. Particularly, oocytes that are found to be "pregnancy incompetent", or are immature, may be cultured in a medium containing one or more gene products that are encoded by genes identified as being "pregnancy signature" genes, e.g., hormones, growth factors, differentiation factors, and the like, prior to, during, or after in vivo, or in vitro fertilization. Essentially, the presence of these gene products should supplement for a deficiency in nutritional gene products that are ordinarily expressed by cumulus cells that surround "pregnancy competent" oocytes, and which normally nurture oocytes and thereby facilitate the capability of these oocytes to yield viable pregnancies upon fertilization.

Alternatively, one or more gene products encoded by said pregnancy signature genes may be administered to a subject who is discovered not to produce pregnancy competent oocytes according to the methods of the invention. Such administration may be parenteral, e.g., by intravenous, intramuscular, subcutaneous injection or by oral or transdermal administration. Alternatively, these gene products may be administered locally to a target site, e.g., a female ovarian or uterine environment. For example, a female subject may have her uterus or ovary implanted with a drug delivery device that provides for the sustained delivery of one or more gene products encoded by "pregnancy signature" genes.

Also, the novel CRL amplification protocol of the invention may be used to identify differentially expressed genes from any cell sample, preferably those only available in limited numbers such as e.g., samples used in forensic analysis, pathological samples such as cancer cells, especially cancer stem cells, cell samples suspected of containing an unknown pathogen, cell samples obtained from cells undergoing specific cellular processes such as differentiation, apoptosis, angiogenesis, and the like. This protocol has been found to faithfully and consistently amplify small amounts of RNA to quantities required for microarray analysis.

Thus, in general, the present invention involves the identification and characterization, in terms of gene identity and relative abundance, of genes that are expressed by desired cells, e.g., cumulus cells derived from an egg, preferably human egg, at the time of ovulation, preferably cumulus cells, the expression levels of which correlate to the capability of said egg to give rise to a viable pregnancy upon natural or artificial fertilization and transferal to a suitable uterine environment. Also, the invention identifies a set of genes differentially expressed by human or murine ESCs and metaphase II oocytes.

In one preferred embodiment, of the invention at least 50 to 100 genes that are significantly upregulated or downregulated, by cumulus cells that correlate to the "pregnancy competency" of an oocyte from which said cumulus cells are associated with will be chosen and monitored in the inventive genetic testing methods.

However, while the invention preferably will select at least 50-100 genes from each of said categories, it is anticipated that the inventive methods alternatively may be practiced by monitoring the expression levels of fewer numbers of cumulus cell expressed genes, wherein said genes are similarly selected to be those which correlate to cumulus cells associated with "pregnancy competent" oocytes, i.e., those that are capable of yielding viable pregnancies.

According to the invention, gene expression levels will preferably be detected by the novel CRL amplification protocol provided herein. However other known methods, preferably real time detection methods such as mentioned above may be used to detect and quantify gene expression. Methods for detecting relative gene expression levels are known in the art and well within the purview of the ordinary skilled artisan.

As noted supra, this invention further provides a novel mRNA amplification protocol that is well suited for small cell samples such as those containing only a few or even a single cumulus cell or oocyte or ESC or other desired cells. This amplification protocol is well suited as well for forensic applications where only a minute nucleic acid sample may be available. Also, this technique is useful wherein only a few cells may be isolated from an individual such as adult stem cells, cancer stem cells, other differentiation specific cells, olfactory cells, taste cells, and the like. The present protocol will be useful in the biomedical field such as by medical and veterinary pathologists, e.g. in coordination with Laser-assisted Microdissection of tissues. Particularly, such applications may include cancer-related applications, research and disease diagnosis.

Previously, in order to generate a biotin-labeled antisense aRNA target for GeneChip experiments from limited amount of RNA samples, this entailed the use of commercial kits e.g., those available from a few venders (such as Ambion TX, and Arcturus, CA). All of these kits use the same approach based on the Eberwine T7 amplification method (See Eberwine Biotechniques 20:584-591 (1996)).

By contrast, the present invention provides an improvement thereover that faithfully and consistently amplifies small amounts of RNA to quantities required to perform microarray experiments. The CRL amplification protocol disclosed herein provides a practical approach to facilitate the analysis of gene expression in samples of small quantity while maintaining the relative gene expression profile throughout reactions (Kocabas et al., "Transcriptome Analysis of the Human Oocyte" In Press, 2006).

This amplification protocols achieves at least the following advantages versus available protocols:

(i) global mRNA amplification is possible for a limited number of cells, tissues and micro-dissected biopsy using other (non-CRL) PCR amplification method;

(ii) the protocol is comprised of simple laboratory manipulations;

(iii) the simplicity of the protocol contributes to a high level of reproducibility from experiment to experiment; and (iv) the protocol time is shorter than other methods, in particular when multiple rounds are performed.

Based on these advantages this methodology is well suited for use in the present differential gene expression based-assays which detect genes the expression of which correlates to oocytes or embryonic stem cells as well as other applications wherein the detection of expressed genes in a sample is desired.

Essentially, the CRL protocol is depicted in FIG. 2 and comprises (i) first strand cDNA synthesis coupled with dC tailing by MMLV RT (Rnase H-); (ii) template switching and chain extension by RT; (iii) amplification of cDNA a requisite number of cycles, typically 5 to 50, more preferably around 10-20, more preferably around 15 cycles by LD-PCR using SMART primers; (iv) and production of double stranded DNAs by in vitro transcription using T7 RNA polymerase. As noted this methodology is applicable for amplification of mRNAs in any sample, but preferably is used in amplifying mRNAs from relatively small cell samples such as samples containing a few number of cumulus cells, oocytes, or stem cells.

In the inventive pregnancy signature gene detection methods, cumulus cells will be isolated from oocytes of different female subjects, the oocytes fertilized by known IVF procedures, and the cumulus cells of the corresponding isolated oocytes being subjected to gene expression analysis, i.e., by isolation of total RNA therefrom, amplification of said total RNA, quantification of the relative gene expression levels of said RNAs by microarray analysis and RT-PCR, and the identification of genes, the expression of which correlates to oocytes that give rise to a viable pregnancy.

To effect such identification, as a separate step, the status of embryos fertilized with oocytes derived from each of said cumulus cell samples will be monitored and pregnancy data recorded. Particularly, the relative birth rate and the health status of the newborn for each oocyte will be recorded and the gene expression levels of cumulus cells associated with each oocyte assessed as a function of pregnancy rate, newborn health, among other parameters, e.g., gender. Based on these results, a set of genes the expression of which correlates to pregnancy/health outcome or gender will be identified. ("pregnancy signature").

This set of genes, and the corresponding expression levels is referred to herein as the "pregnancy signature" because these gene expression levels correlate to the development of a viable pregnancy and ultimately the production of a healthy newborn. While this "pregnancy signature" may comprise as many as 50, 100 or even 200 genes, it is anticipated that a fewer number of genes, e.g., on the order of 20 or less genes, may be sufficient to develop a suitable "pregnancy signature".

The genes which constitute the "pregnancy signature" may include genes which encode gene products that are involved in the nutritional and developmental requirements of the oocyte, i.e., maturation and development, and the potential of the oocyte to be capable of yielding a viable pregnancy. These gene products may include growth factors, hormones, transcription factors, differentiation promoting agents, and the like. After the "pregnancy signature" is obtained, the corresponding genes are sequenced, the DNA sequences are then used to deduce the identify the corresponding polypeptide sequences, and these sequences then compared to databases of available human or other gene sequences to identify the identity of the gene products that correlate to the ability of an oocyte to yield a viable pregnancy. Genes which are differentially expressed by human oocytes are identified infra and include such pregnancy signature genes. Further statistical analysis of the relative levels of expression of these genes, or subsets of such genes, will identify preferred subsets of these genes that constitute a "pregnancy signature" of a viable oocyte, i.e., one that is pregnancy competent. Some genes found to be differentially expressed in cumulus cells are contained in SEQ ID NO's 1-513 infra. Additionally, FIG. 19 contains the sequences of three genes which are differentially expressed and expressed at different levels in human cumulus cells associated with oocytes that give rise to viable pregnancies versus cumulus cells associated with oocytes that do not give rise to viable pregnancies. These three genes are the human arginine methyltransferase gene (PRMT5) and its transcript variants and other allelic variants, the human gene identified in FIG. 19 as Clone IMAGE 5299642 and contained in deposited NCBI Accession Sequence BC041913; ACTB, and human BTG family member, member 2, BTG2, and contained in deposited NCBI Accession Sequence NM_006763. The results of the gene expression experiments contained in Example 3 suggest that these 3 genes are all expressed at detectably higher amounts in cumulus cells that are associated with oocytes that give rise to viable pregnancies versus those that do not. While the expression results are qualitative and have not yet been quantified the qualitative results would reasonably suggest that these genes are all expressed at levels which are least 2-3 fold greater in cumulus cells associated with oocytes that give rise to viable pregnancies, and likely up to 5-10-fold greater. Therefore, detecting the expression of these genes by cumulus cells derived from different donor oocytes, e.g., those to be used in an IVF procedure may be used as one means of predicting the pregnancy potential of the oocytes associated therewith, i.e., cumulus cells with higher levels of expression of these genes are more likely to be associated with oocytes useful in IVF procedures. Therefore, these genes may be used as part of the pregnancy signature set of genes the expression of which is assayed in order to assess the pregnancy potential of oocytes from a donor, e.g., a patient who is contemplating being an IVF donor. Also, these gene expression procedures may be used to assess the pregnancy potential of oocytes in an individual who is undergoing fertility treatments, an individual who is near menopause (perimenopause), or an individual who has or had a disease or condition or treatment that potentially would impact the viability and quality of her oocytes such as radiation or chemotherapy.

As noted previously, these polypeptide gene products which are found to be deficient in pregnancy incompetent oocytes may be added to in vitro culture media containing oocytes in order to enhance their pregnancy competency or alternatively may be administered in vivo as part of a fertility treatment regimen.

EXAMPLE 1

Exemplification of CRL Amplification Protocol of the Invention with Oocyte and ES Cell Samples Oocyte Collection, Total RNA Extraction and Reference RNA Human oocytes were obtained from 3 patients undergoing an assisted reproductive treatment (ART) at the unit of Reproductive Medicine at Clinica Las Condes, Santiago Chile. The selection criteria for the donors was a) less than 35 years old, (b) reproductively healthy with regular ovulatory cycles; (c) male factor as the only cause of infertility , (d) considerable number of developing follicles that assured spared oocytes. The experimental protocol was reviewed and approved by a local independent Ethics Review Board. All donors signed informed consent. At the time of this application filing, all three donors has already conceived, two of them got pregnant during the ART cycle in which the samples were collected, and the third one got pregnant following a spontaneous cycle with artificial insemination using donated sperm. Ovarian stimulastion and oocyte retrieval and isolation were performed as described herein.

Three groups of 10 oocytes were used. Total RNA was isolated following the guanidium thiocyanate method (28) using the PicoPure RNA isolation kit (Arcturus, CA) following manufacturer's instructions except only 6.6 micromolar elution buffer was used and the elution was repeated at least 3 times using the first eluate. All RNA samples within the purification column were treated with the Rnase-Free Dnase (Qiagen, CA). Extracted RNA was stored at −80 degrees C. until used as a template for cDNA synthesis. The quality and quantity of extracted total RNA from 8 matured oocytes (independent from the 30 oocytes used in this experimental study (was evaluated using the Agilent 2100 bioanalyzer (Agilent Technologies, CA). Each mature oocyte was found to have about 330 pg total RNA when the Arcturus' RNA isolation kit was used. Quality of RNA was intact as shown in FIG. 3. Reference RNA (100 micrograms) was prepared by mixing 10 micrograms total RNA from each of 10 different normal human tissues including skeletal muscle, kidney, lung, colon, liver, spleen, breast, brain, heart and stomach (Ambion, TX).

RNA Amplification for GeneChip Analysis (FIG. 4a)

First-strand cDNA synthesis: the following reagents were addded to each of 0.5 ml Rnase-free tube: 5 micromolar total RNA (3 ng for the reference and5 microliters, about 3 ng, for the oocyte samples) and 300 ng of an anchored T7-Oligo(dT) 24 V promoter primer (Ambion TX). The reaction tubes were incubated in preheated PCR machine at 70 degreees C. for 2 min and transferred to ice. After denaturation, trhe following reagents were added to each tube: 1.4 microliters of SMART II A oligonucleotide (5'-AAGCAGTGGTATCAACGCA-GAGTACGCGrGrGr-3") (SEQ ID NO: 514) (Clonetech, CA), 4 microliters of 5× first-strand buffer, 2 microliters of 20 mm DTT, 0.6 microliters of 5 mg/ml T4 Gene 32 Protein (Roche, IN), 2 microliters of 10 mM dNTPs, 20 U Rnase inhibitor (Ambion, TX) and 1 microliter PowerScript Reverse Trasnscriptase (Clontech, CA). After gentle mixing, reaction tubes were incubated at 42 degrees C. for 60 minutes in a hot-lid thermal cycler. The reaction was terminated by heating at 70 degrees C. for 15 minutes and purified by NucleoSpin Extraction Kit (Clontech, CA).

Double-stranded cDNA synthesis by Long-distance (LD)-PCR, cDNA purification: PCR Advantage 2 mix (9 microliters) was prepared as follows: 5 microliters of 10× PCR Advantage buffer (Clontech, CA), 1 microliter of 10 mM dNTPs, 100 ng 5' SMART upper primer (5'-AAGCAGTGG-TATCAACGCAGAGTA-3') (SEQ ID NO: 515), 100 ng 3' SMART lower primer (5'-CGGTAATACGACTCACTAT-AGGGAGAA-3') (SEQ ID NO: 516), and 1 microliter of Polymerase Mix Advantage 2 (clontech, CA). This mix was added to 41 microliters of the first-strand cFDNA synthesis product, and thermal cycling was carriedout in the following conditions: 95 degrees C. for 1 minute, folowed by 15 cycles, each consisting of denaturation at 94 degrees C. for 30 sec, annealing at 62 degrees for 30 sec, and extension at 68 degrees C. for 10 min. The cDNA was purified by NucleoSpin Extraction Kit following the manufacturer's insructions.

In vitro transcription (IVT), biotin labeled aRNA purification and aRNA fragmentation is described herein.

Microarray Analysis: Transcription profile of each sample was probed using Affymetrix Human Genome U133 Plus 2.0 GeneChips. The raw data obtained after scanning the arrays was analyzed by dChip (29). A smoothing spline normalization method was applied prior to obtaining model-based gene expression indices, a.k.a. signal values. There were no outliers identified by dChip so all samples were carried on for subsequent analysis.

Pathway analysis was performed using Ingenuity Software Knowledge Base (Redwood City, Calif.) which is a manually created database of previously published findings on mammalian biology from the public literature. We used the network analysis using the knowledge base to identify interactions of input genes within the context of known biological pathways.

Gene ontology (GO) was performed using EASE. Given a list of genes, EASE forms subgroups based on the functional categories assigned to each gene. EASE assigns a significance level (EASE score) to the functional category based on the probability of seeing the number of subgroup genes within a category given the frequency of genes from that category appearing on that microarray (30)

Comparison with External Data Sets

Mouse MII oocyte transcriptome data was obtained from Su et al., who used custom designed Affymetrix chips to obtain gene expression profiles of oocytes and 60 other mouse tissue types. (31) Using their expression database we identified 3,617 differentially upregulated transcripts in the mouse oocyte by using the median expression value of the remaining 60 samples as the baseline (Supplementary dataset 1, not. shown). We selected transcripts with an expression value in oocyte samples that are 2-fold higher than the base-line.

Human embryonic stem cell (hESC) data was derived from the work of Sato et al. who profiled human stem cells and their differentiated counterparts using Affymetrix HG-U133A representing around 2200 transcripts. (32)

We analyzed raw data using dChip and identified 1,626 hESC genes by selecting transcripts significantly upregulated in human stem cells compared to their differentiated counterparts (Supplementary dataset 2, not shown).

Finally for mouse ES cells we used a list of 1,687 differentially upregulated mouse ES genes published by Fortunel et al. (33) which were identified by comparing mouse ES cells to differentiated cells using Affymetrix MG-U74Av2 chips representing around 1200 transcripts (Supplementary dataset 3, not shown). We used Affymetrix' NetAffix tool for mapping genes across organisms and platforms used in the respective studies.

RESULTS AND CONCLUSIONS

Validation of Amplification Fidelity (Amplified vs. Non-Amplified RNA)

A critical step in the analysis of gene expression on small samples is the faithful amplification of mRNA molecules present in the sample. We have designed a PCR based amplification system using the combination of SMART UII A oligonucleotide (Clontech, CA) and T7-Oligo (dT) promoter primers ("CRL amplification protocol"). (FIG. 3a) We have isolated total RNA from a human cell line and 20, 3 and 1.5 ng input total RNA was amplified using CRL amplification protocol. For each experiment, 15 micrograms of fragmented aRNA was hybridized to a single Affymetrix Human Genome U133 Plus 2.0 array. Non-amplified RNA from the original sample (12 micrograms) was run in parallel by using the MessageAmp II aRNA Kit (Ambion, TX). Gene expression results from both amplified vs non-amplified RNA samples were compared and the correlation coefficients were found to be 0.94. (FIG. 3b), 0.03, and 0.91 respectively for 20 ng, 3 ng, and 1.5 ng of total input RNA respectively. CRL amplification protocol was repeated two times with 20 ng initial total RNA from the same cell type and the correlation between the two experiments was 0.99. These results show that the subject RNA amplification strategy faithfully and consistently amplifies even small amounts of RNA to quantities required to perform microarray experiments. The CRL amplification protocol provides a practical approach to facilitate the analysis of gene expression in samples of small quantity while maintaining the relative gene expression profile throughout reactions.

Differentially Upregulated Genes in the Human Oocyte

We generated a databases of the human oocyte transcriptome by comparing the transcripts in the oocyte and the reference samples which contain mRNA from several somatic tissues. A complete list of up and down regulated genes, functional comparative and correlation analysis is provided (see Supplementary dataset 4). Compared to reference samples there were 5,331 transcripts significantly up-regulated and 7,074 transcripts significantly down-regulated in the oocyte. Genes up-regulated in oocyte samples included most of the well-known germ cell specific genes, such as FLGLA, STELLA, VASA, DAZL, GDF9, ZP1, ZP2, MOS, OCT4, NPM2, and H1F00. (FIG. 4), Our analysis also confirms the presence of pathways previously described in the mouse, in particular the TGF-beta pathway (FIG. 5)

Validation of Microarray Data

Figure 4:
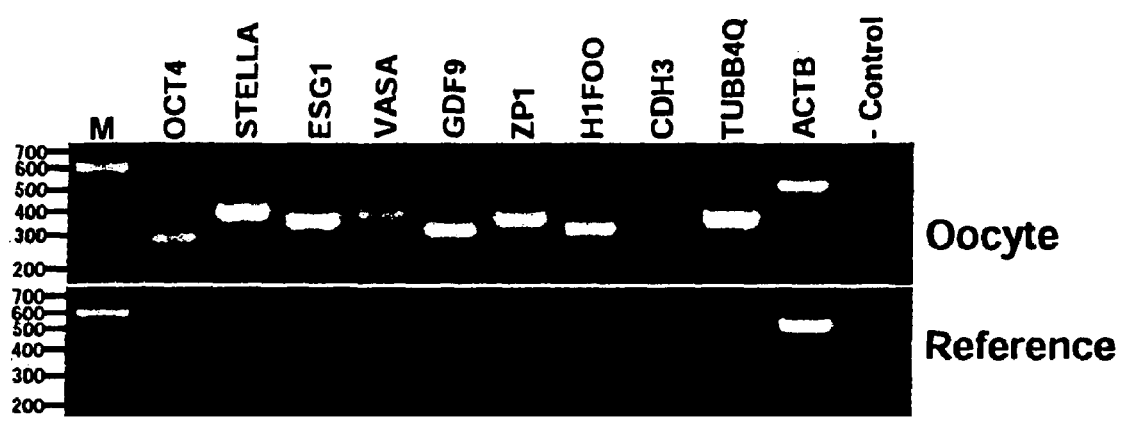
FIG. 4 contains RT-PCR verification of GeneChip array results for samples as described infra.

A selected list of genes known to be expressed in the oocyte was used to validate the microarray results by TR-PCR (FIG. 4). These genes were found to be present in the oocyte sample and absent in the reference RNA.

Functional Annotation of Genes Over-Expressed in the Human Oocyte

To examine the biological processes performed by the oocyte, we implemented EASE (36), contrasting the genes over-expressed in the oocyte with all the genes present in the Affymetrix chip (Table 1). One of the top over-represented categories found in oocytes was related to RNA metabolism. This is in agreement with the fact that oocytes store RNA to support the events of fertilization and early embryonic development until the embryonic gene is activated. (34, 35, 36) DNA metabolism and chromatin modification were also over-represented categories, in agreement with the need of the oocyte to remodel the sperm chromatin upon fertilization.

Cell cycle related categories were the most over-represented. Many genes known to be involved in the regulation of the meiotic cell cycle Many genes known to be involved in the regulation of the meiotic cell cycle were detected (MOS, AKT2, CDC25, and PLK1) (37) Detection of gametogenesis and reproduction as over-represented categories further suggests the accuracy of this transcriptional profiling. Protein kinases and phosphatases denoted another functional category over-represented in oocytes. Many of the cell cycle regulatory genes (AURKB, CDC25, DCD7, PLK1, CDC23 and plk3) and some receptors of the TGF superfamily (ACVR1, ACVR2B, and BMPR1A and 1B) were in this category.

An important category that is highly represented in thr oocyte was related to nucleic acid metabolism and regulation of transcription. Although transcriptionally silent at the MII stage, the oocyte is very active in transcription and translation during its growth phase and must be prepared to initiate transcription at the time of embryonic genome activation, 4- to 8-cell stage in human (38). Many of the genes in this category represent Zinc0-finger proteins that are not yet fully characterized, providing an opportunity to discover new transcriptional regulatory networks that operate during embryonic genome activation.

We also found that chromatin remodeling genes are well represented in the human oocyte. Genes in this category expressed in the human oocyte were: DNA methyltransferases (DNMT1, DNMT3a, and DNMT3B), histone acetyltransferases (NCOA1, and 3, SRCAP, GCN5L2 and TADA2L), histone deacetyltransferases (HDAC3 HDAC9, SIRT7), methyl-CpG-binding proteins (MBD2 and MBD4), histone methyltransferases (EHMT1 and SET8), ATP-dependent remodeling complexes (SMARCA1, SMARCA5, SMARCAD1, SMARCC2, SMARCD!) and other chromatin modifying genes (ESR1, NCOA6, HMGB3, HMGN1 and HMGA1).

These GO results validate our transcriptome analysis when compared with candidate gene analysis already reported in other species but more importantly, shed new light into a large number of biological processes that take place in the human oocyte.

Intersection between Human Oocyte and Mouse Oocyte Transcriptome

Figure 6:
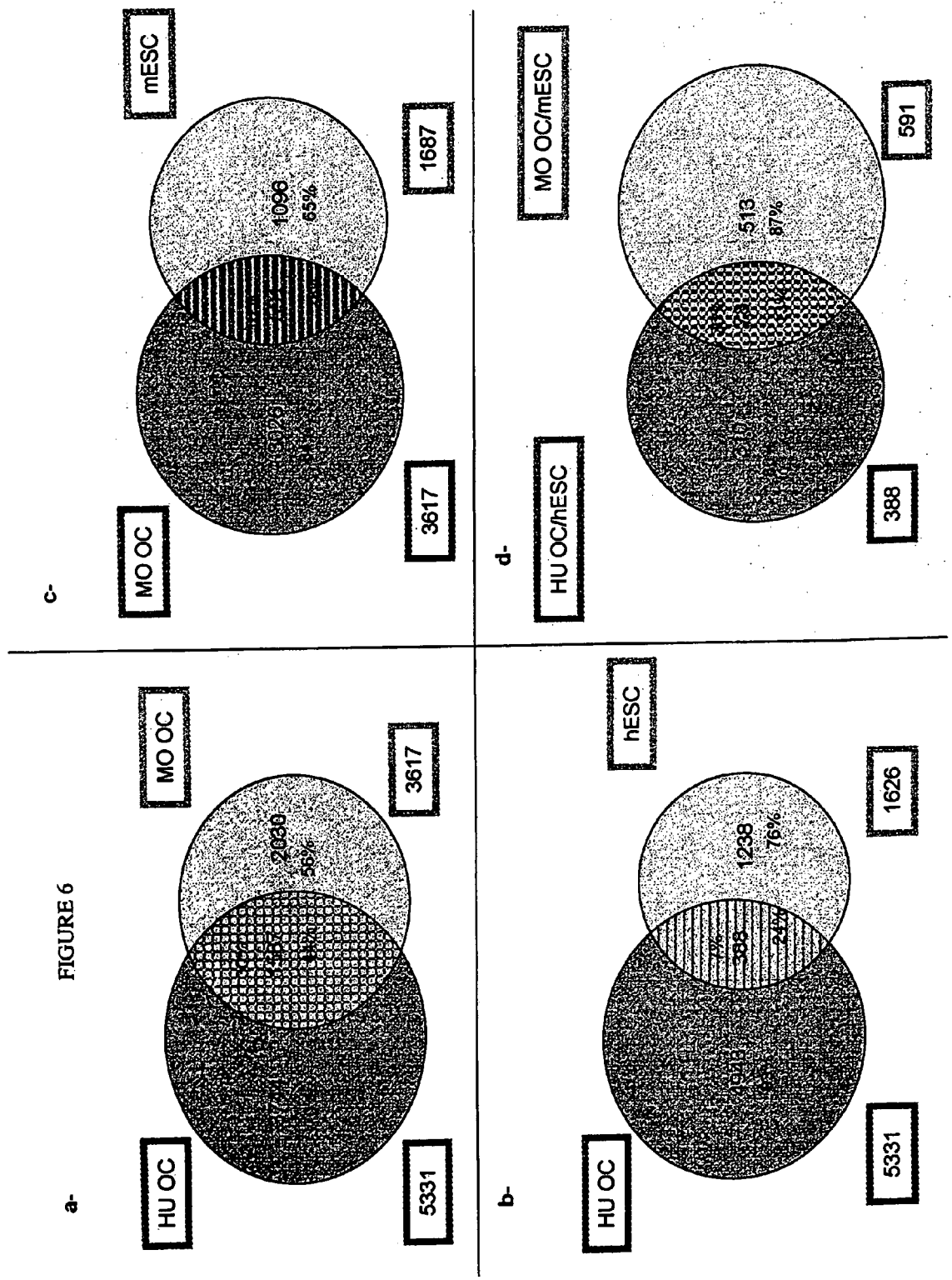
FIG. 6 contains Venn diagrams depicting intersection of differentially expressed genes in human and mouse oocytes and ESCs.
Figure 10:
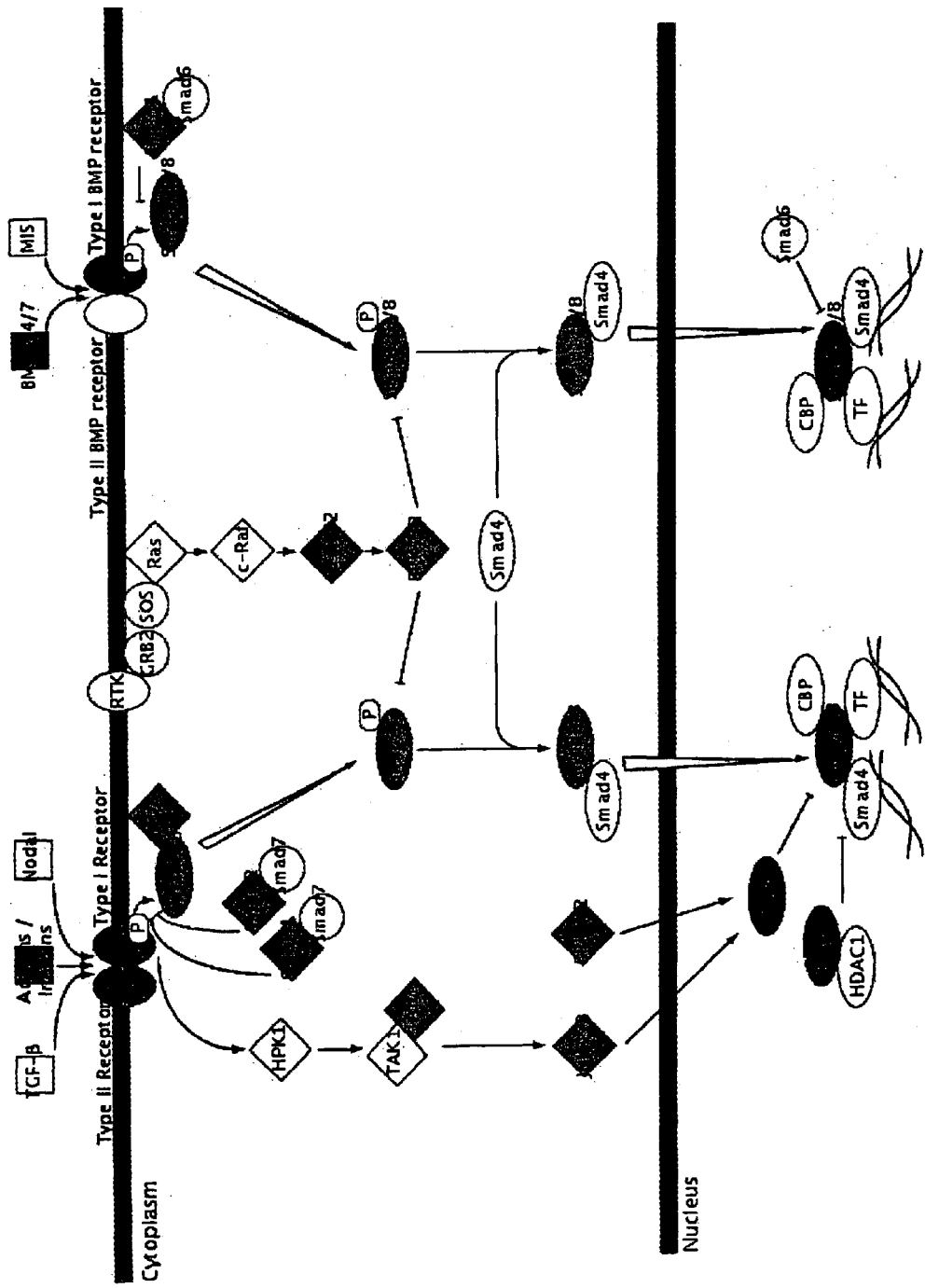
FIG. 10 contains genes differentially expressed in human oocytes corresponding to TGF-beta signaling pathway.
Figure 11:
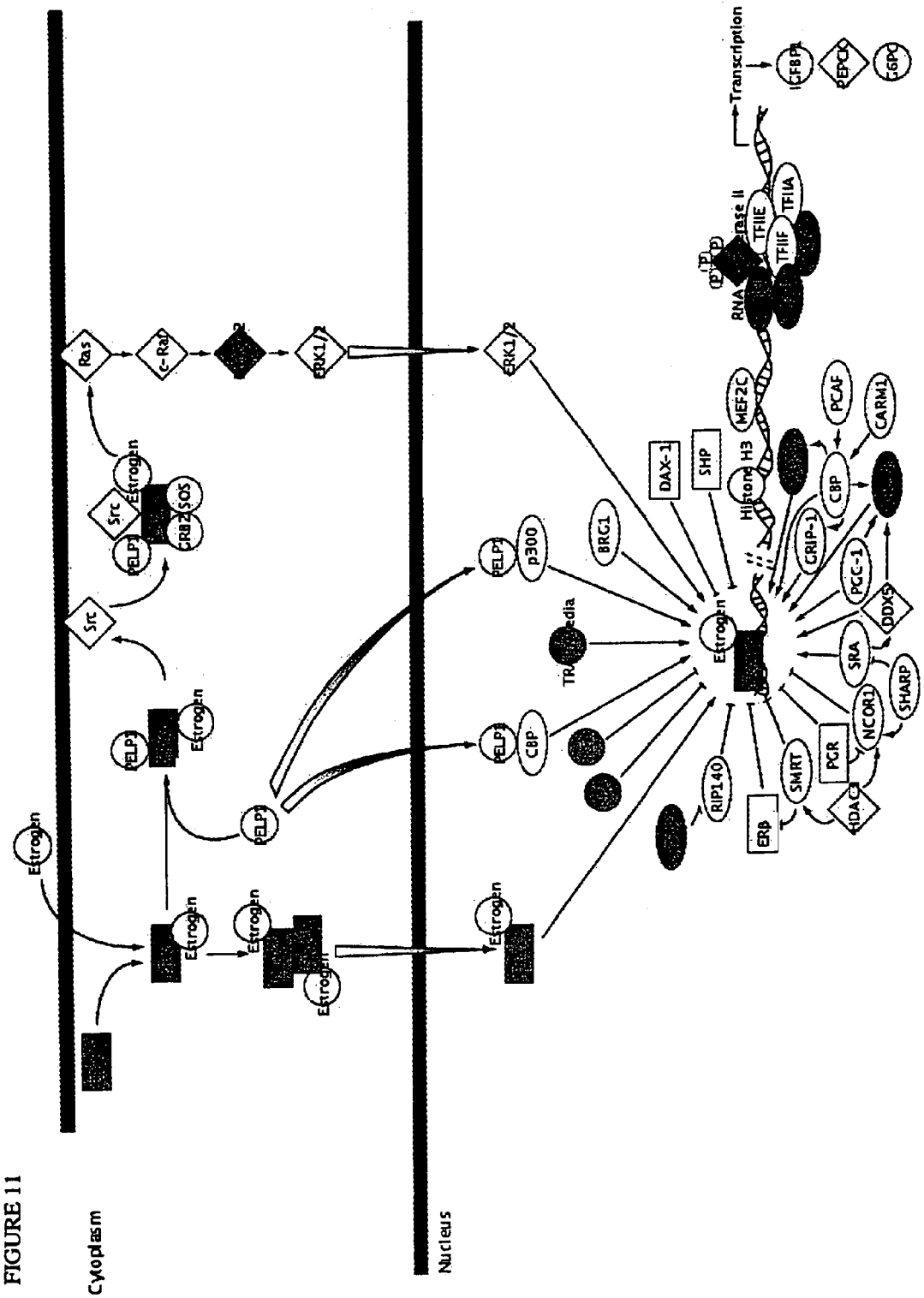
FIG. 11 contains gene that are differentially expressed in human and mouse oocytes that are in the estrogen receptor signaling pathway.

Mouse has been the best model for genetic studies and several groups have already reported the transcriptome analysed of mouse oocytes. (39) In an effort to find differences and similarities between the human and mouse oocyte, we compared our human oocyte transcriptome results with that of mouse oocyte transcriptome derived from data of Su et al. (35) The intersection of the two transcriptomes yielded a set of 1587 genes to be common in both mouse and human oocytes, indicating genes of conserved function in mammalian oocytes (FIG. 6a, Supplementary dataset 5). Table S2 shows the functional characterization of 16 of the top 100 intersected genes which have functions described in mouse oocytes. Many of these genes relate to oocyte maturation, from the first meiotic division to MII arrest, encompassing various controls of cell cycle checkpoints and cellular machinery for DNA segregation and cell division. Using the Ingenuity software to analyze the intersection of these two datasets we found that the estrogen receptor (ER) signaling pathway is represented in human and mouse oocytes (FIG. 6) Genes significantly upregulated in this pathway were CTBP2, ESR1, GTFH1, GTF2H2, MAP2K1, NCOA1, NCOA3, PCQAP, PHB2, POLR2C, POLR2J, RBM9, TAF3, TAF4, TAF4B, TAF5, TAF6, TAF12, and TBP. Recent studies in knockout models for aromatase have shown that estrogen is not required for the generation of preimplantation embryos. (40) However, our study suggests that in the oocyte some genes associated with the ER pathways are transcribed, perhaps in response to hormonal stimulation during folliculogenesis and oocyte maturation. Like with the EGF pathway, it remains to be determined whether the ER pathway has a role during preimplantation development in human embryos.

Considering thr High Degree of Similarity

EXAMPLE 2

Description

Phase I: At the clinic, embryologists will remove the cumulus cells of two eggs and fertilize them. Embryos will be transferred to the uterus of a woman and cumulus cells sent to the laboratory for analysis. Once the cells arrive to the laboratory, RNA will be isolated and microarray analysis performed using Affymetrix platform. Pregnancy tests will be done by ultrasound on day 30 and embryonic sacs counted. There will be three kinds of outcomes: 1) 0 sacs; 2) 1 sac and 3) 2 sacs. A minimum of 30 volunteer women will participate during this phase. Ten with no sacs, ten with one sac and ten with 2 sacs. Pregnancy data will be correlated with gene expression obtained from the cumulus cells isolated from those same eggs. One hundred genes that directly correlate with pregnancy —either by upregulation or downregulation—will be further analyzed using real time RT-PCR. The best 20 genes that correlate with pregnancy (positively or negatively) will be called "pregnancy signature" and used for later testing at the clinic.

Phase II: Blind validation of genes in the pregnancy signature. At the clinic, the embryologist will isolate RNA from cumulus cells from each oocyte that will be later fertilized. Half of the RNA will be sent to our laboratory and the rest will be used for real time RT-PCR analysis to be performed on site. Gene expression of the "pregnancy signature" will be measured. Embryologists will transfer embryos without knowing the outcome of gene expression analysis. One hundred women will be asked to participate as volunteers in this part of the study. At the time pregnancy results are obtained, the study will be unmasked and results from each individual will be correlated with gene expression analysis. We anticipate that the "pregnancy signature" put forward in phase 1 will be validated during this phase.

Alternative Strategy: In the event of an unexpected outcome i.e., the pregnancy signature is not validated; microarray analysis will be run once more using the RNA provided by the clinic in phase 2. It is anticipated that having 100 more samples will result in the identification of a clear pattern of gene expression in cumulus cells from eggs capable (or non-capable) of generating a healthy pregnancy/baby.

Using microarray analysis as described above, the genes identified infra were found to be differentially expressed by cumulus cells obtained from eggs of women donors. The expression of those particular genes which correlate to pregnancy (positive or negative) will establish a "pregnancy signature", i.e., genes the expression or absence of expression of which correlates to a positive pregnancy outcome and "infertility signature", i.e., specific genes the expression or absence of expression correlate to fertility problems or abnormalities.

This is effected preferably by microarray analysis. For example, comparison of expression between two samples on filter arrays may be performed by comparing nucleic acids obtained from normal oocyte cells to those obtained from a donor suspected of having ovarian dysfunction that renders oocytes pregnancy incompetent on two duplicate filters or alternatively a single filter may be used that is stripped and hybridized sequentially.

Direct comparison of gene expression in two samples can be achieved on glass arrays by labeling the two samples with different fluorophores. This technique allows the evolution of repression of gene expression as well as induction of expression. The two fluorescently-labeled cDNAs are then mixed and hybridized on a single glass or filter array. Glass arrays have the advantage of allowing the simultaneous analysis of two samples on the same array under the same hybridization conditions.

Gene arrays containing sequences of genes implicated in pregnancy ("pregnancy signature") will allow high-throughput screening of individuals for diagnostic purposes or tailor-made treatments.

Arrays of polynucleotides, the expression of which corresponds to, or are complementary to the sequences of genes identified by the method of the invention therefore provide a further aspect of the invention. Such an array will include at least two nucleic acid sequences, preferably at least 10, and more preferably at least 20, e.g., 50 genes or more that correspond to the sequence of, or are complementary to genes, the expression of which (positive or negative) the positive pregnancy outcome in cells obtained from oocyte donors, e.g., women suspected to have ovarian dysfunction as a result of disease, age, and the like. Protein arrays form a further aspect of the invention and will contain polypeptides encoded by such pregnancy signature genes or antibodies which bind thereto.

Recent developments in the field of protein and antibody arrays allow the simultaneous detection of a large number of proteins.

EXAMPLE 3

Figure 12:
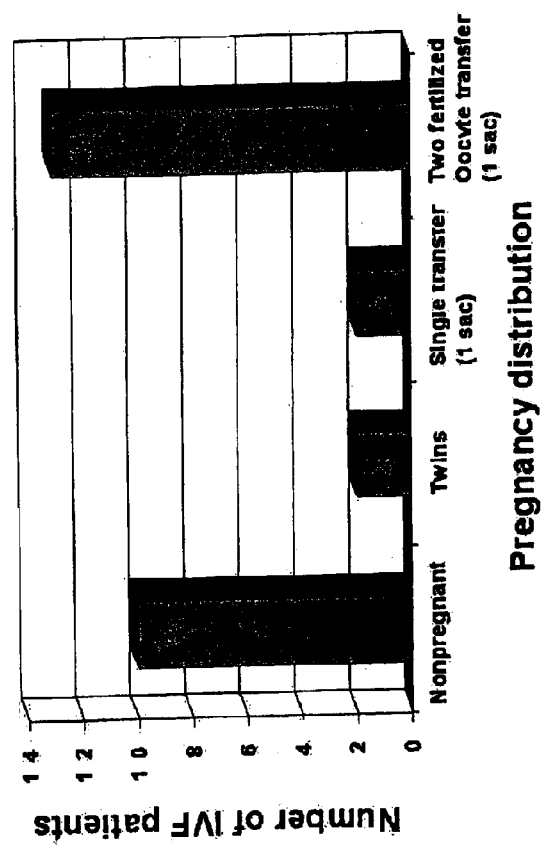
FIG. 12 contains progeny distribution of 27 analyzed in vitro fertilization (IVF) patients.

Identification of 3 Pregnancy Signature Genes which are Differentially Expressed by Cumulus Cells and wherein the Expression Levels of which Correlate to Pregnancy Outcome of Associated Human Oocytes There are no prior reports describing correlations between overall gene expression in cumulus cells and pregnancy establishment of human embryos. A study essentially as described in Example 2 was conducted to identify differentially expressed genes between cumulus cells surrounding competent and noncompetent oocytes using Affymetrix GeneChip technology. To achieve this goal cumulus cells were classified according to pregnancy outcome of their matching oocytes following in vitro fertilization (IVF) treatments. The cumulus cells from 2 oocytes per patient undergoing IVF treatment were lysed and the oocytes were fertilized and transferred to the recipient women, 2 embryos per recipient with the exception of 2 that received a single embryo. Total RNA isolated from the cumulus cell lysates was amplified by the novel amplification protocol described supra that combined template-switching PCR and T7-based amplification methods. A total of 52 cumulus cell samples were analyzed from 27 donors (FIG. 12). A gene-by-gene mixture model analysis was used to compare microarray measurements of gene expression on cumulus cells between pregnant and non-pregnant patients. 2,604 differential expressed genes were considered as potential discriminant candidates of competent and noncompetent oocytes.

Figure 13:
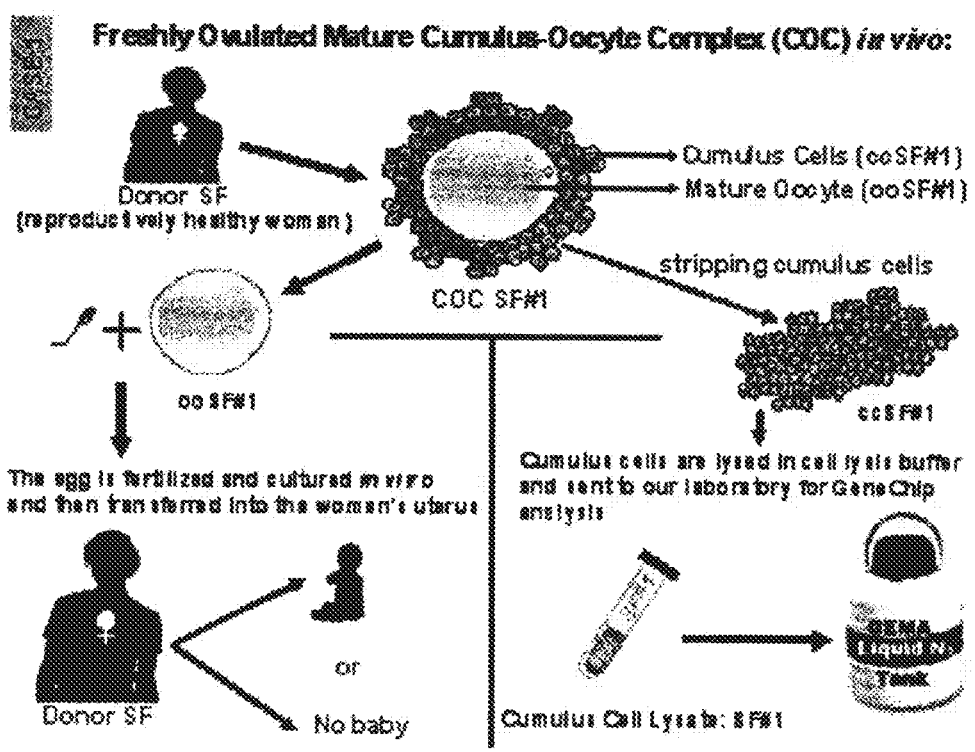
FIG. 13 contains a detailed flow chart describing the steps of the invention starting from the IVF clinic to the gene expression results. Panel A illustrates a sample collection from freshly ovulated mature cumulus-oocyte complex in vivo. Panel B shows quality and quantity checking of total RNA from 4 different cumulus cell lysates.
Figure 13:
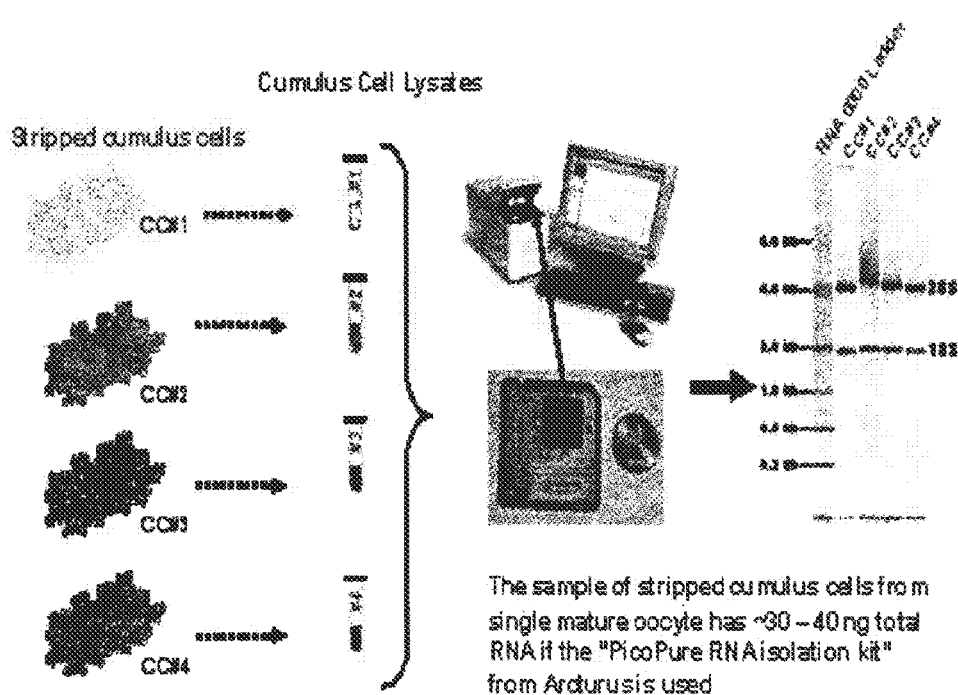
Figure 14:
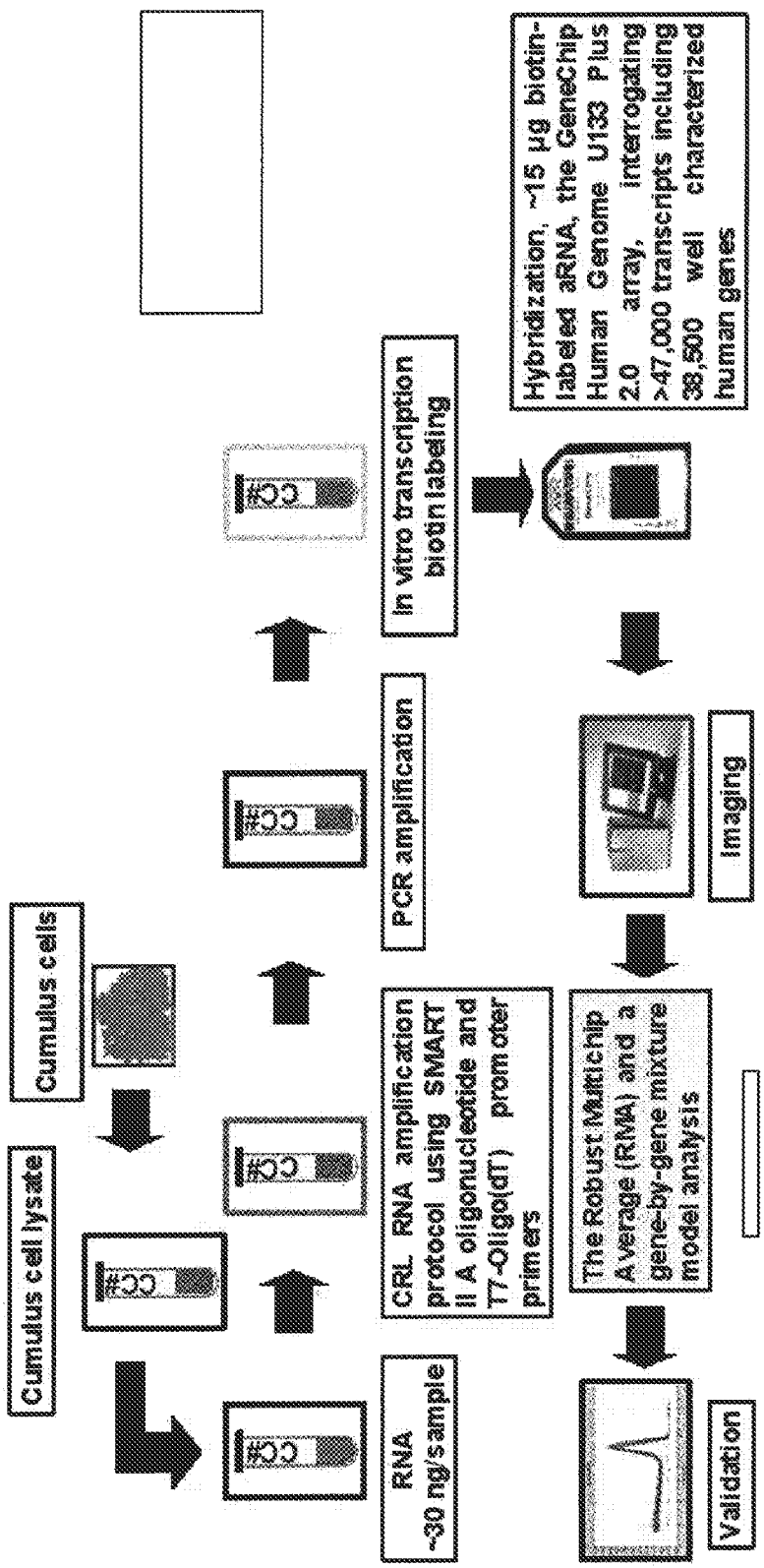
FIG. 14 depicts schematically the experimental design of the protocol in more detail than FIG. 1.
Figure 15:
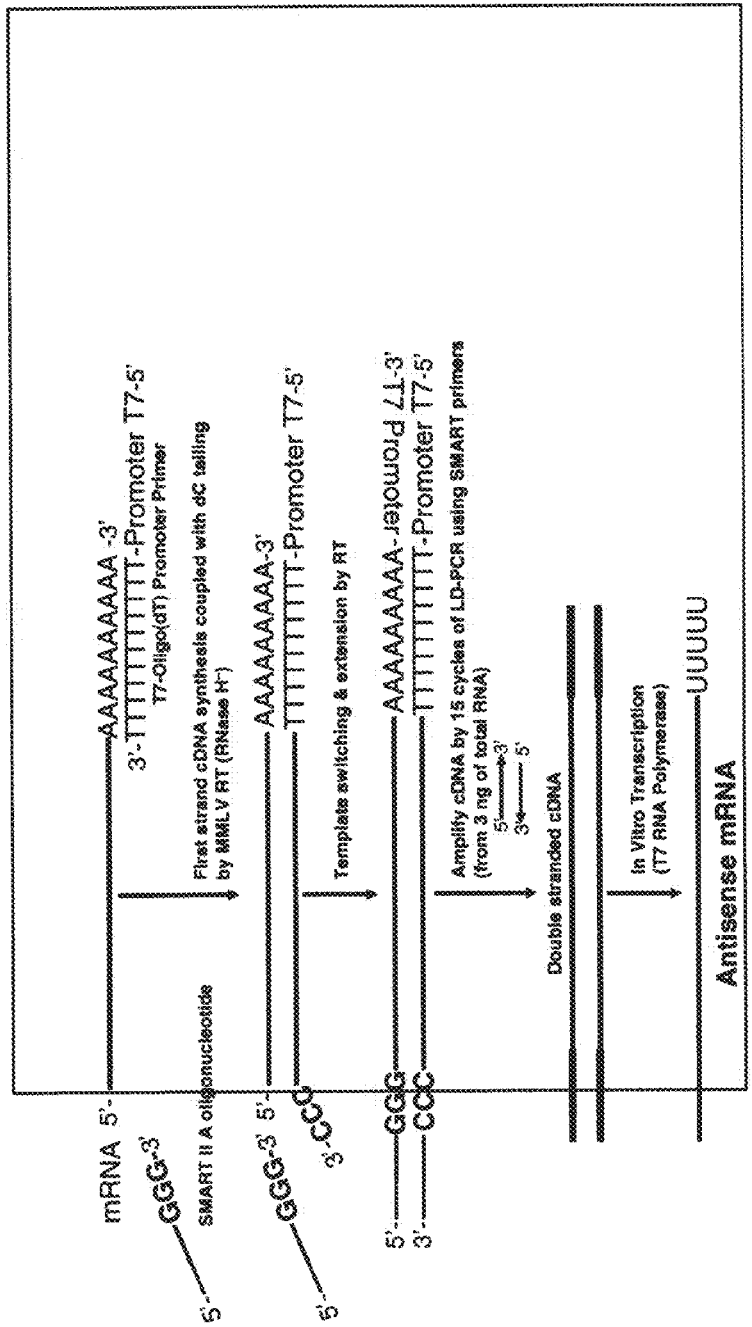
FIG. 15 contains a summary of CRL RNA amplification protocol described herein. Panel B shows the means of validating amplication fidelity. Figure discloses SEQ ID NO: 517.
Figure 15:
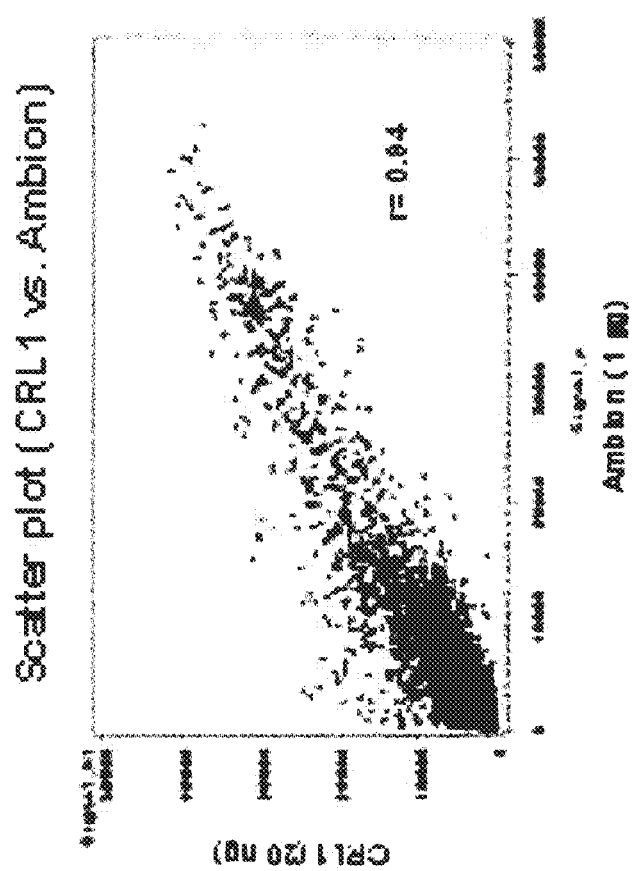

A flow chart of the specific procedures used is contained in FIG. 13 which shows how the quality and quantity of total RNA from different cumulus cell lysates is verified. The Experimental Design is also depicted schematically in FIG. 14 and the CRL amplification protocol and a scatter plot of the obtained results by the CRL amplification versus another method (Ambion) is contained in FIG. 15.

Figure 16:
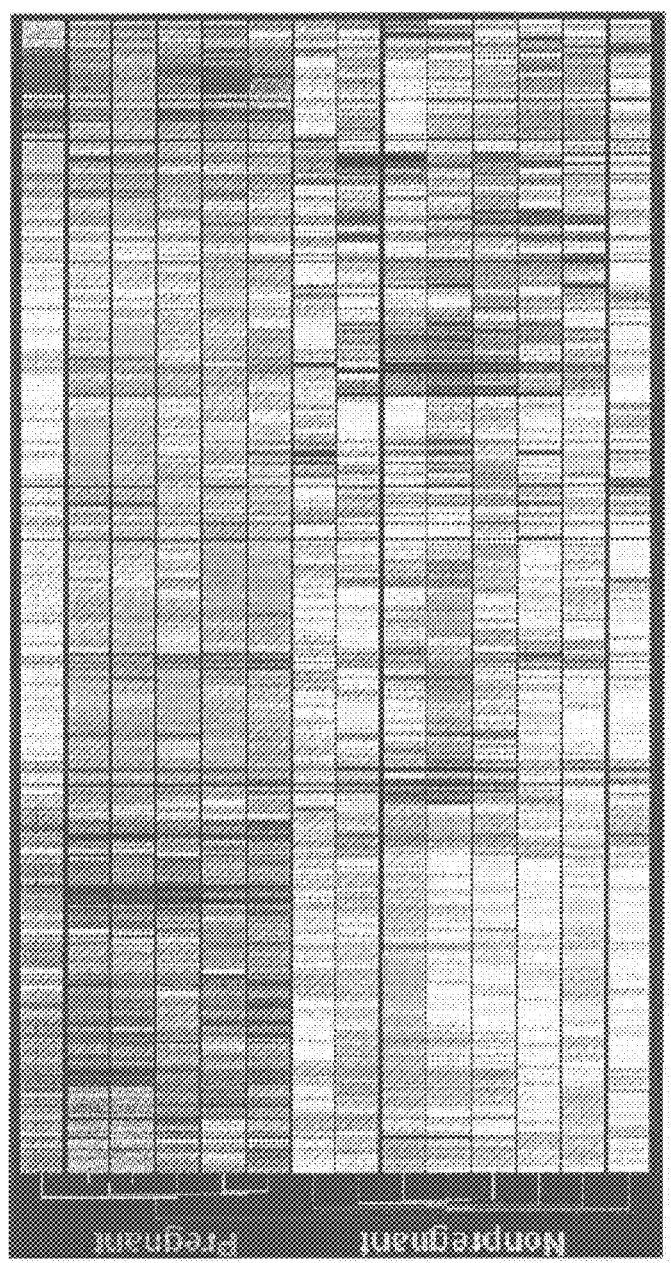
FIG. 16 shows clustering of samples using genes that are called present on 4 pregnant and 4 non-pregnant donor samples (442 probe sets).

As shown in FIG. 16 a comparison of the differential expression profiles of genes by cumulus cells of oocytes that give rise to pregnancies from 4 pregnant donor samples versus 4 donor samples that did not give rise to pregnancy reveals a clustering of samples using genes that are called present on the 4 pregnancy donor samples and 4 non-pregnant donor samples (442 probe sets).

Figure 17:
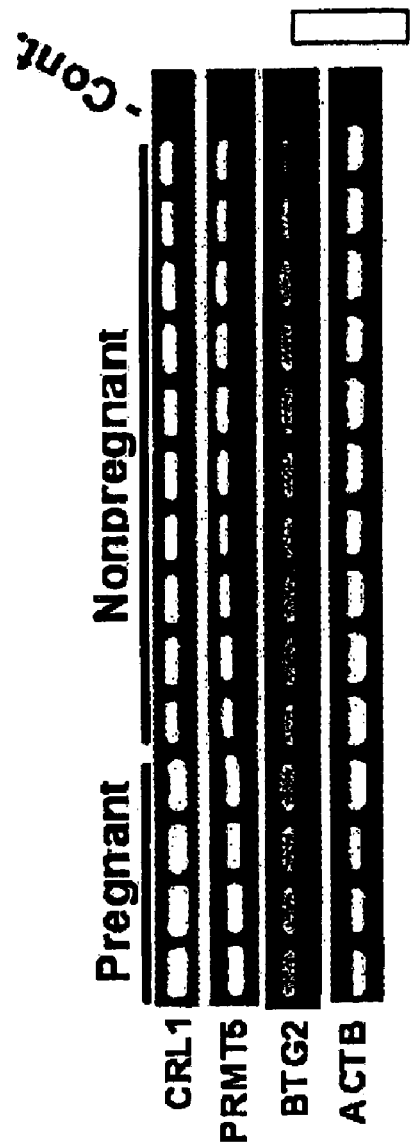
FIG. 17 contains experimental patterns of 3 candidate pregnancy markers in cumulus cells that resulted in pregnancy versus no pregnancy.

FIG. 17 contains the expression patterns of 3 candidate pregnancy marker genes in cumulus cells that produced pregnancy versus non-pregnancy. Additionally, FIG. 18 contains a Table containing the top 10 functional gene categories over-represented in differentially expressed genes between cumulus cells emanating from oocytes that produce pregnancies versus those that failed to produce pregnancies. Gene ontology and biological process and molecular function as detected by EASE when oocyte expressed genes were compared to the genes represented in the GeneChip array.

These results provide the first known comprehensive expression baseline (transcriptome) for the genes which are expressed in the human cumulus cells that surround a pregnancy-competent oocyte. As discussed, these genes may serve as markers for the quality and pregnancy outcome of the oocyte and can be used to monitor and optimize the factors that are related to developmental competence, such as patient specific medical treatments and medical conditions, hormone treatments, and embryo culture conditions. In addition, the effective development of pregnancy markers such as the genes which are contained in FIG. 19 can increase the probability of a healthy pregnancy and viable birth; reduce the chances of multiple births, physical and emotional burden, and the costs in treatments and hospital stays. Additionally, identifying these genes may facilitate an understanding of the underlying biology and help explain how the levels of expression of these genes may impact or cause female infertility.

TABLE-US-00001 LENGTHY TABLE REFERENCED HERE US20070238111A1-20071011-T00001 Please refer to the end of the specification for access instructions.

TABLE-US-00002 LENGTHY TABLE The patent application contains a lengthy table section. A copy of the table is available in electronic form from the USPTO web site. An electronic copy of the table will also be available from the USPTO upon request and payment of the fee set forth in 37 CFR 1.19(b)(3).

Sequence CWU 0 SQTB SEQUENCE LISTING The patent application contains a lengthy "Sequence Listing" section. A copy of the "Sequence Listing" is available in electronic form from the USPTO web site. An electronic copy of the "Sequence Listing" will also be available from the USPTO upon request and payment of the fee set forth in 37 CFR 1.19(b)(3).

Lengthy table referenced here

US07858308-20101228-T00001

Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US07858308B2). An electronic copy of the table will also be available from the USPTO upon request and payment of the fee set forth in 37 CFR 1.19(b)(3).

SEQUENCE LISTING (541 sequences)

SEQ ID NO: 1 - DNA, 870 bp, Homo sapiens
  modified_base (9)..(9): a, c, g, or t
  modified_base (99)..(99): a, c, g, or t
  modified_base (103)..(103): a, c, g, or t
  modified_base (106)..(107): a, c, g, or t
  modified_base (109)..(109): a, c, g, or t
  modified_base (112)..(114): a, c, g, or t
  modified_base (116)..(117): a, c, g, or t
  modified_base (119)..(119): a, c, g, or t
  modified_base (121)..(130): a, c, g, or t
  modified_base (840)..(870): a, c, g, or t
gcttttgtntccggtgagttttgtggcgggaagcttctgcgctggtgcttagtaaccgactttcctccggactcctgcacgacctgctcctacagccgngcgntcnncnccnnngnngntnnnnnnnnnnggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatacaaaagttagctgggtgtggtggcagaggcctgtaatcccagctccttgggaggctgaggcgggagaattgcttgaacccggggacggaggttgcagtgagccgagatcgcactgctgtacccagcctgggccacagtgcaagactccatctcnnnnnnnnnnnnnnnnnnnnnnnnnnnnnnn

SEQ ID NO: 2 - DNA, 1107 bp, Homo sapiens
  modified_base (641)..(641): a, c, g, or t
tccaaaaaaataaagctctcagggagacatgaataaaatcaatgaacattagaaaataaaatatagatgcttaccattaacctaccaactcttaatatccttaaattatgtgatatataaagaggactgttacttttttactttttttttttttttttttttggctttgctttatttatttgtagttgggggctaacgttttctcttttctttctattgatcctgttgtggttgggtttcctgtggagagagtagtttgtcctgttgcactagaacattatttactcactaaattgagtttttcagtcaattaacaaatatttattaagttcctactatgtaccaggcatagtagggctacaatggtaagcaagacagagtccctgcccccaaagagcttatattctaatggggatattaagggatgaatagaataccaatgtgtgcactgtacaggaatcatactatttaaaaataatttgtataaactataatgcttagcacagatggcgagttatctgtgctatgtgaaagctgtgaaatagtgctctaagagttgtcaagagctgtggttttacatcttttcctcattgcaaatttagtgactttctacacactatatggaaataaatgactagcanataaaacagtcataaatacaaagcagaggttgcactcccccaatcccgagttaacccaggtctgcaataacaccatgttaaaggtgcagatagagacttggctcaaaaaggcttggagatgaggaagattggaatataatgatggttttgtctgttccttaactaaagtgcctctatgtatattcttttctatttgtagcaggataaatttggtctggctcagttttggaactgtattttgaaaatggctttgtcttacagtttaaggaatagacaggtggagggaaagtcacataaaggagcaagtttgtgtagctgtccctcttgccccttttaatcatcctcctttgatatggccatcctggtgggcctcctttgccatttccatttttggtttctttccctgaaaactgtgtgcaggtaattccatgtgccattgttgaaaagaaaaaaaaaaaaagaaaaa

SEQ ID NO: 3 - DNA, 5468 bp, Homo sapiens
  modified_base (8)..(8): a, c, g, or t
  modified_base (717)..(717): a, c, g, or t
  modified_base (719)..(720): a, c, g, or t
  modified_base (771)..(771): a, c, g, or t
  modified_base (784)..(784): a, c, g, or t
  modified_base (823)..(823): a, c, g, or t
  modified_base (834)..(834): a, c, g, or t
  modified_base (836)..(836): a, c, g, or t
  modified_base (847)..(847): a, c, g, or t
  modified_base (860)..(860): a, c, g, or t
  modified_base (873)..(873): a, c, g, or t
  modified_base (875)..(875): a, c, g, or t
  modified_base (886)..(886): a, c, g, or t
  modified_base (888)..(888): a, c, g, or t
  modified_base (899)..(899): a, c, g, or t
  modified_base (927)..(927): a, c, g, or t
  modified_base (934)..(934): a, c, g, or t
  modified_base (965)..(965): a, c, g, or t
  modified_base (967)..(967): a, c, g, or t
  modified_base (978)..(978): a, c, g, or t
  modified_base (980)..(980): a, c, g, or t
  modified_base (1147)..(1147): a, c, g, or t
  modified_base (1149)..(1149): a, c, g, or t
  modified_base (1160)..(1160): a, c, g, or t
  modified_base (1173)..(1173): a, c, g, or t
  modified_base (1175)..(1175): a, c, g, or t
  modified_base (1186)..(1186): a, c, g, or t
  modified_base (1513)..(1513): a, c, g, or t
  modified_base (1649)..(1649): a, c, g, or t
  modified_base (1651)..(1653): a, c, g, or t
  modified_base (2170)..(2170): a, c, g, or t
  modified_base (2258)..(2258): a, c, g, or t
  modified_base (2260)..(2260): a, c, g, or t
  modified_base (2658)..(2659): a, c, g, or t
  modified_base (2661)..(2662): a, c, g, or t
  modified_base (2664)..(2669): a, c, g, or t
  modified_base (2671)..(2676): a, c, g, or t
  modified_base (2679)..(2680): a, c, g, or t
  modified_base (2683)..(2689): a, c, g, or t
  modified_base (2696)..(2698): a, c, g, or t
  modified_base (2700)..(2702): a, c, g, or t
  modified_base (2704)..(2704): a, c, g, or t
  modified_base (2706)..(2706): a, c, g, or t
  modified_base (3128)..(3128): a, c, g, or t
  modified_base (3909)..(3911): a, c, g, or t
  modified_base (3922)..(3922): a, c, g, or t
  modified_base (3932)..(3932): a, c, g, or t
  modified_base (3944)..(3944): a, c, g, or t
  modified_base (4046)..(4046): a, c, g, or t
  modified_base (4058)..(4058): a, c, g, or t
  modified_base (4112)..(4112): a, c, g, or t
  modified_base (4690)..(4691): a, c, g, or t
  modified_base (5386)..(5387): a, c, g, or t
  modified_base (5435)..(5436): a, c, g, or t
tttttttnttttttttttttttttttttctttaaatagttcacatttattattgataacaataaaaaaatcttttaaagactatcagtattgtattaccaagtgaggtaatatgtttacaaaacatttacagaatttgatatgcaaataacaaatttaggaaggaaagtgaattaagacataatagagggagaatcaaagaatcattagtactaagaaatgggaaatgacagcagcgttttaaaagagtggcaaggtactaaaggtagaaacacgatgcaaactgcatactcaaaccatagctgccccagaattcccttacaaggggagtgagattggattactcgggaggaaaccctgtaagcatttgtgcggtcatgtgctttgagctcttcaagatgcactacagtctttgggtataaaagaatgccactcccgaatcaacttaaaaagaacagatcttcagcctgggagggggcaggggatggctgcaattcaaacagttctataaacatctctgggcacatgaggactgttgagtgaagcattttcttggcagctgtcagcaaaatcgccatctgagacacagagaaagagaaagagaaagcagggaccaccttcaggcccttgtgatttgggaacaggaagcaccaggtggaagcagcacagacgcgctactaaccctacctacgaaccctacctacgaaccctacctacnanncctacctactagccctacctactagccctacctactagccctacctactanccctacctactanccctacctactagccctacctactagccctacctactanccctacctacnanccctacctacnaaccctacctacnaaccctacctacnanccctacctacnanccctacctacnaaccctacctactagccctacctactanccctacnctactagccctacctactaaccctacctacnanccctacctacnanccctacctactaaccctacctactagccctacctactagccctacctactaaccctacctactagccctacctacgaaccctacctactagccctacctactaaccctacctaccagccctacctacgaaccctacctactaaccctacctactagccctacctacnanccctacctacnaaccctacctacnanccctacctacnaaccctacctactagccctacctactaaccctacctaccagccctacctacgaaccctacctactaaccctacctactagccctacctactagccctacctactaaccctacctactagccctacctacgaaccctaccgcgctttccggaagcaaaggcttcaggtaccactgaggagctcgatctctaagagcaaacacaaatgtggtccaaaggcaggtgatcacagcacaggccctgggacgtctacagtgtgcaggcagccactagggctgacccgaccgggcaagagggctgctcggtccctcccccgccctcctgatccntgcacggggcacacatggcctccacacagctctccagtcacgcagcacccacacagtgccttcagagcggagctgagacggcacaaccaggatctccatgcctaccacgcacacagttgacagccgcgtggggttngnnntgaaaaacacggcctctgctgcacacagaaacacgtgttgcatgtccttatcgtggaggccatcccctatgcaacttctggacagattctcaaataacctgcttttcccataaaaagctgaaaaaataagggcctgtaccagatagagcaggctttaaaatcaggaattaaacaaaatgtaaaaggcaaacaaatcccatattctgatttgcttctgtgaagattccttcattactcaaactaagtttccactcaccccgtccccccagcacccccaccgtcatgcacacatgcacacacacagcacatgcacacacacacacgcatgagtccacaattcccatgtacaaagaagcaggactcctacatgccacacgccaccctgaagtggatgcgagagctgctgcttagctactaataaaaccccatggacagtgtcaagtggcaaatgcgacttgctggttccaagacggcctcctagtggctggaactgtctgggctctgagacaatgagccnccagagggcacagaggagatggcctacactgggctgggagctgactgcaggtgagaggggcgacgcacggaaggaaacgggaagaacncncccacccaagttcacatacagaaaaatcctgctctaaaaagtatcaaaaagatttgaaaaggaggaaagagaaagtaatgtttaacgatggcagcattttcctggagtcaccaggagtccctgagagcccctcctgagcccccggccccactgcagacagtgggtggtgtgggtgtgtctggccctgggacaaggtactccgcaggcaacctctgaatcctcagaggataaggacctcaagggctggccctaagtccacagaccatcttgactggcgggaagcatgggggccgtgaggcggcgtgcgggccatgaggcagcttgggggaagcgagctggcagcttccgtcccaggtgaggaggggccatctctggaggatgtcacaggaattcattcnntnntnnnnnntnnnnnnttnnttnnnnnnnttttttnnntnnntntntgagaccacgtcaatcctttaattggtacagaaactacttttctttcaagagagcccttgcgctctggttggattttgtgcacaacgtatacaaaatctatggctattgagttaagttaggatcagagttaaaactacctgccaaggtagttttgggatcaaacgactacgtttaccatctgagagctatttgctatctagaggtgagaggagtctgtacaatgtcgccgctgggtgggcgggtgcagctggctgtccgaggaggggcggccgtcccctctgcacactaggtgcaggcagcgcggcactacctggagatcatggagctggagtgggactggctggaggaggtggtggcggcactcagctgggagaagccgctgtggctggactccaggctcgtcatggaacctctgaaatcnctccgagccgatcacctcggtgtagtacatcactttacacttgtgcgaagagacctgcagggacgcaagcacgtcgtccacccggggaaggctgctggcggcgcacgcaggcatgctgtggaatttccactgcaggatgtagaagcccggccacctggtcacatgggaaccctgcacgctttctccttctttgcagatcagaggcgactccaccatgctgtagtcgcggcccagctgccagactttgtctatgagctgcacattgttcccacccggagaggtgatgctgtgggctcccagggagtcctttttgggtggttgtggcgacctcttggagtgatagatgttaaacacaatgtcccctttgcacacgtcgaaatcccaagtgatgactgacgaggcatccacaatctgaatgagaatctcatgtggggctcctttgaagacgcttgcagactggtagatggtctcagtccagagcttcaggtcttcgttctccagctcctctgcagtccggtacagagatttggggaccagtccaccctctggcacttcgcacatgcactccccactcaggaaatctggaataatctctttgtcgatgtaatccagcaggcctccaggaccctggtagtcatttcctgcataaatgaggaacttccttctggtgttgtcatcaatgaacggactaaccagcgtccagagcacaggaaataccctgggcgcccgcaggatgagaaggcggcccagtgtctcagggtagttggcctccaccacctcnnntgatccgcagncagcgctttncacaccaggtcnccacaagtggcgcatgttcagcccttccaagtccaccaggcaggtccatgagctgataggccgaccaaagacttttgtattctcttcgcatcgccttagccnttcttcatttanggagagaacgtatctcagcagggcttcctccccgagcgctctcaccaagccttnggtgtccatctgccccagcctgagcacgtagaggggccgcccatctttgtcgtgatgatgccagcctcccgcgtagtaatcctgaaggacctgaggaggggtccaggtttcaagaatgtagtctacctgatgctgctttctccacgtcaaagactgacacatgatctctctggctttgtcaatattaaaatcccgtgcacggaggaaccgaagaatatgctcatcttttggaattttgcccttgtgggtctcctggagccactggcgaagtctaatgaggcagctctcctgcagcggagtcaaatcgcccaggtatctcttgatgtagtcggcatctagtttgtcgtcaggggtgcccaccacgggctcaggtgcactggggctgctgagggcatcaccactcagcccctccttgagggcagcttctgggatgacgacggccatggacgctgcttgtttcttggaggatgatgaagatgtctctgaagagggcgtgatggaaggcggactccaacggggcacaaaggttatgccttcttcttctaattggcgaaggtagtattcgatgatttcctttnnttttttaatgttgctggtatattgtttcattgcaattttttccactgtactttcaaaaccaaagaaagatttaatatctaaacttgcagactgttcaaaacaggtccaatcttcattttcagggtgaacggtgtagcagcaatgctcattaatgatgacccgattggaaaacgtttcattataagcctcaatgtgcaaagtacgttcccgagaattcagtgagtttttctggacaaaataaacataatcaactcctgcaatcttcttcagcagtctgggtgcatctacatccagcttgcagcgcctttcaatgacatgaatagccccatcttcgctcttgaattcattcacagtgtcactgcccacgaacatcggaatcaaaggacatgtagggaacctcctttcataggcagccataattaattcaaaggggtatttgtacaccctcactggggactggtatttctgcaccatgattgcaatacaacagcaaccctctcacacctgtcttgttgaggataatcattaagaatggtactttatgctgaacatggtgagaggatattcaaacatacaaaactgaatatcctcaaggagcccgaagtctagctcttgtcagaaaggccgggcctgggacacggggtggcgaggggcgctcataccggcggctccgcggggcagtctcggttccactnntccgcgaccgtagctcgaccgccggttccggggagggggccggggagnngggagggggaaggggcgcggcgacggcacttg

SEQ ID NO: 4 - DNA, 1639 bp, Homo sapiens
agcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgagccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaagaaacaattgggtacccagttaaattttcatttcagataaacaacaaataattttttagtataagtacattattgtttatctgaaagttttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaaaaaaaaaaaaaaa

SEQ ID NO: 5 - DNA, 424 bp, Homo sapiens
  modified_base (40)..(40): a, c, g, or t
atgtctcttgtcagctgtctttcagaagacctggtggggnaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggctggcagcccacaaaaaaagccatgaagaaagccacaaagagtagctgagttactgcccagaggctgggcccctgacatgtacctgcagaataataaagtcatcaatacctcaaaaaaaaaaaaaaaaaaaaa

SEQ ID NO: 6 - DNA, 576 bp, Homo sapiens
actcttctggtccccacagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgccctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgccccttgggcctccccccagcccctcctccccttcctgcacccgtacccccgtggtctttgaataaagtctgagtgggcggc

SEQ ID NO: 7 - DNA, 3025 bp, Homo sapiens
gcacgagcaggcagttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtctgcaaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagcccttcagcaccactgcaggataaccgaactcaaggcttaattaacggggcactaaacaaaacaaccaataaagtcaccagcagtattactatcacaccaacagccacacctcttcctcgacaatcacaaattacagtaagtaatatatataactgaccacgctcaccctcatccagtccatactgatatttttgcaaggaactcaatccttttttaatcatccctccatatcccccaagactgactgaactcgtactttgggaaggtttgtgcatgaactatacaagagtatctgaaactaactgttgcctgcatagtcatatcgagtgtgcacttactgtatatcttttcatttacatacttgtatggaaaatatttagtctgcacttgtataaatacatctttatgtatttgaaaaaaaaaaaa

SEQ ID NO: 8 - DNA, 4175 bp, Homo sapiens
tgaggagtcctgctcaagacacggtcactggatctgagaaacttcccaggggaccgcattccagagtcagtgactctgtgaagcacccacatctacctcttgccacgttcccacgggcttgggggaaagatggtggggaccaaggcctgggtgttctccttcctggtcctggaagtcacatctgtgttggggagacagacgatgctcacccagtcagtaagaagagtccagcctgggaagaagaaccccagcatctttgccaagcctgccgacaccctggagagccctggtgagtggacaacattgttcaacatcgactacccaggcgggaagggcgactatgagcggctggacgccattcgcttctactatggggaccgtgtatgtgcccgtcccctgcggctagaggctcggaccactgactggacacctgcgggcagcactggccaggtggtccatggtagtccccgtgagggtttctggtgcctcaacagggagcagcggcctggccagaactgctctaattacaccgtacgcttcctctgcccaccaggatccctgcgccgagacacagagcgcatctggagcccatggtctccctggagcaagtgctcagctgcctgtggtcagactggggtccagactcgcacacgcatttgcttggcagagatggtgtcgctgtgcagtgaggccagcgaagagggtcagcactgcatgggccaggactgtacagcctgtgacctgacctgcccaatgggccaggtgaatgctgactgtgatgcctgcatgtgccaggacttcatgcttcatggggctgtctcccttcccggaggtgccccagcctcaggggctgctatctacctcctgaccaagacgccgaagctgctgacccagacagacagtgatgggagattccgaatccctggcttgtgccctgatggcaaaagcatcctgaagatcacaaaggtcaagtttgcccccattgtactcacaatgcccaagactagcctgaaggcagccaccatcaaggcagagtttgtgagggcagagactccatacatggtgatgaaccctgagacaaaagcacggagagctgggcagagcgtgtctctgtgctgtaaggccacagggaagcccaggccagacaagtatttttggtatcataatgacacattgctggatccttccctctacaagcatgagagcaagctggtgctgaggaaactgcagcagcaccaggctggggagtacttttgcaaggcccagagtgatgctggggctgtgaagtccaaggttgcccagctgattgtcacagcatctgatgagactccttgcaacccagttcctgagagctatcttatccggctgccccatgattgctttcagaatgccaccaactccttctactatgacgtgggacgctgccctgttaagacttgtgcagggcagcaggataatgggatcaggtgccgtgatgctgtgcagaactgctgtggcatctccaagacagaggaaagggagatccagtgcagtggctacacgctacccaccaaggtggccaaggagtgcagctgccagcggtgtacggaaactcggagcatcgtgcggggccgtgtcagtgctgctgacaatggggagcccatgcgctttggccatgtgtacatggggaacagccgtgtaagcatgactggctacaagggcactttcaccctccatgtcccccaggacactgagaggctggtgctcacatttgtggacaggctgcagaagtttgtcaacaccaccaaagtgctacctttcaacaagaaggggagtgccgtgttccatgaaatcaagatgcttcgtcggaaagagcccatcactttggaagccatggagaccaacatcatccccctgggggaagtggttggtgaagaccccatggctgaactggagattccatccaggagtttctacaggcagaatggggagccctacataggaaaagtgaaggccagtgtgaccttcctggatccccggaatatttccacagccacagctgcccagactgacctgaacttcatcaatgacgaaggagacactttcccccttcggacgtatggcatgttctctgtggacttcagagatgaggtcacctcagagccacttaatgctggcaaagtgaaggtccaccttgactcgacccaggtcaagatgccagagcacatatccacagtgaaactctggtcactcaatccagacacagggctgtgggaggaggaaggtgatttcaaatttgaaaatcaaaggaggaacaaaagagaagacagaaccttcctggtgggcaacctggagattcgtgagaggaggctctttaacctggatgttcctgaaagcaggcggtgctttgttaaggtgagggcctaccggagtgagaggttcttgcctagtgagcagatccagggggttgtgatctccgtgattaacctggagcctagaactggcttcttgtccaaccctagggcctggggccgctttgacagtgtcatcacaggccccaacggggcctgtgtgcctgccttctgtgatgaccagtcccctgatgcctactctgcctatgtcttggcaagcctggctggggaggaactgcaagcagtggagtcttctcctaaattcaacccaaatgcaattggcgtccctcagccctatctcaacaagctcaactaccgtcggacggaccatgaggatccacgggttaaaaagacagctttccagattagcatggccaagccaaggcccaactcagctgaggagagcaatgggcccatctatgcctttgagaacctccgggcatgtgaagaggcaccacccagtgcagcccacttccggttctaccagattgagggggatcgatatgactacaacacagtccccttcaacgaagatgaccctatgagctggactgaagactatctggcatggtggccaaagccgatggaattcagggcctgctatatcaaggtgaagattgtggggccactggaagtgaatgtgcgatcccgcaacatggggggcactcatcggcggacagtggggaagctgtatggaatccgagatgtgaggagcactcgggacagggaccagcccaatgtctcagctgcctgtctggagttcaagtgcagtgggatgctctatgatcaggaccgtgtggaccgcaccctggtgaaggtcatcccccagggcagctgccgtcgagccagtgtgaaccccatgctgcatgagtacctggtcaaccacttgccacttgcagtcaacaacgacaccagtgagtacaccatgctggcacccttggacccactgggccacaactatggcatctacactgtcactgaccaggaccctcgcacggccaaggagatcgcgctcggccggtgctttgatggcacatccgatggctcctccagaatcatgaagagcaatgtgggagtagccctcaccttcaactgtgtagagaggcaagtaggccgccagagtgccttccagtacctccaaagcaccccagcccagtcccctgctgcaggcactgtccaaggaagagtgccctcgaggaggcagcagcgagcgagcaggggtggccagcgccagagtggagtggtggcctctctgagatttcctagagttgctcaacagcccctgatcaactaagttttgtggtacttcaccctcttctgccctcatttcatgtgacagccattgtgagactgatgcacaaactgtcacttggttaatttaagcacttctgttttcgtgaatttgcttgtttgtttcttcatgcctttacttactttgtcccatgctactgattggcacgtggcccccacaatggcacaataaagcccctttgtgaaactgttctttaaatgaaacacaagaaattggccactggtaaaactctgcagcttcaactgtacttcatttaatgccattaatgcaaatatacttcctcttctttttgcatggttttgcccacctctgcaatagtgataatctgatgctgaagatcaaataaccaatataaagcatatttcttggccttgctccacaggacataggcaagccttgatcatagttcatacatataaatggtggtgaaataaagaaataaaacacaatacttttactggaaaaaaaaaaaa

SEQ ID NO: 9 - DNA, 1547 bp, Homo sapiens
ggcacgagccagtctccgcgcctccacccagctcaggaacccgcgaaccctctcttgaccactatgagcctcccgtccagccgcgcggcccgtgtcccgggtccttcgggctccttgtgcgcgctgctcgcgctgctgctcctgctgacgccgccggggcccctcgccagcgctggtcctgtctctgctgtgctgacagagctgcgttgcacttgtttacgcgttacgctgagagtaaaccccaaaacgattggtaaactgcaggtgttccccgcaggcccgcagtgctccaaggtggaagtggtagcctccctgaagaacgggaagcaagtttgtctggacccggaagccccttttctaaagaaagtcatccagaaaattttggacagtggaaacaagaaaaactgagtaacaaaaaagaccatgcatcataaaattgcccagtcttcagcggagcagttttctggagatccctggacccagtaagaataagaaggaagggttggtttttttccattttctacatggattccctactttgaagagtgtgggggaaagcctacgcttctccctgaagtttacagctcagctaatgaagtactaatatagtatttccactatttactgttattttacctgataagttattgaaccctttggcaattgaccatattgtgagcaaagaatcactggttattagtctttcaatgaatattgaattgaagataactattgtatttctatcatacattccttaaagtcttaccgaaaaggctgtggatttcgtatggaaataatgttttattagtgtgctgttgagggaggtatcctgttgttcttactcactcttctcataaaataggaaatattttagttctgttttcttggggaatatgttactctttaccctaggatgctatttaagttgtactgtattagaacactgggtgtgtcataccgttatctgtgcagaatatatttccttattcagaatttctaaaaatttaagttctgtaagggctaatatattctcttcctatggttttagatgtttgatgtcttcttagtatggcataatgtcatgatttactcattaaactttgattttgtatgctattttttcactataggatgactataattctggtcactaaatatacactttagatagatgaagaagcccaaaaacagataaattcctgattgctaatttacatagaaatgtattctcttggttttttaaataaaagcaaaattaacaatgatctgtgctctgcaaagttttgaaaatatatttgaacaatttgaatataaattcatcatttagtcctcaaaatatatacagcattgctaagattttcagatatctattgtggatcttttaaaggttttgaccattttgttatgaggaattatacatgtatcacattcactatattaaaattgcacttttattttttcctgtgtgtcatgttggtttttggtacttgtattgtcatttggagaaacaataaaagatttctaaaccaaaaaaaaaaaaaaaaaaa

SEQ ID NO: 10 - DNA, 8992 bp, Homo sapiens
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaaacccttagtctgaaactttagcaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtaaacaggttaacttagagtagagatggtgaatatgtgaacctgaggaaaggaagaaatagattaaattatctggagagagaggaaaagtcagcagaatggggacgagaatctttcggagctcagtgttctgataggagttatttccttgggcataggttccaagtatttttctaatataccatagaagccaggaaaactttcttctgttatctcaaatgatttaattactgacttgagtttgtgttgtctccttagacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatgaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgag

SEQ ID NO: 11 - DNA, 667 bp, Homo sapiens
cgtgcaccctgagccggagctgcccagtcgccgcgggaccggggccgctggggtctggacgggggtcgccatgatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagcaccccaccccggccccggcccctcctggaatcgcctgctcgcttccccttcccaggcccgtggccaacccagcagtccttccctcaactgcctaggaggaagggacccagctgggtctgggccacaagggaggagacttcaccccacttcctctgggccctggctgtgggcagaggccaccgtgtgtgtcccgagtaaccgtgccgttgtcgtgtgattccataagcgtctgtgcgtggagtccccaataaacctgtggtcctgcctggc

SEQ ID NO: 12 - DNA, 5316 bp, Homo sapiens
atcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtgtgtgtgcgcgtgcattgattactatccatttctttagtcaacgctctccacttcctgatttctgctttaaggaaaactgtgaactttctgcttcatgtatcagttttaaagcatcccaggcaaagatcatctacagattctaggaattctctcccctgaaatcaaaacctggagacttttttttcttattttagttgagaagttcataaactgctcaaggattagttttccaggactctgcggaggaacggcaggaagaacctcagagagggcagaggtgacttcaaagtgctggggactccgtcctgagggtcacttggccctgagcccctgcgtgcccttgcggaagcccagaagcttcttcctgctgcacctcccgtttccgctgctgctgacgtttatgcatttcatgatggggtccaacaagaacacctgacttgggtgaagttgtgcaatattggaggctgactgtagggctgggcagctgggagacaggctcatggctcatggctcatggctcagggcggtgcctgccctgggccgggacccccctccccaccccccacctaggctttttgggttttgttcaaggaaggtaaagtgagaggtttaggtcagtgtttttaagtttttgttttttttttaaagcaaatcctgtatatgtatctacatgggagataggtagacactacttatttgttacattttgtactatacgtttgtgttccaggtttcagcttccctcgctcctgttgttaagaagcgtccctgtcagcacaggtgtgcattgaggaaggggccccagggccttcgctccctcagcactggggtggaggcggcaggaaggggcggcccttacctggcaggtctgggcgcacctttagcaggtggactccgtggggctccaccagccagaagcctctggaaggcaacgaaggcaatgctgctccctgagtccagtccccgcccccaaacccagcccaggtgccttcagctacttcggcttcttaaaccctgcagtgttaaacagaggcattgagaaaggggaaaggcgggtatttttaaaagccaaagattgacccaagttacttgagggtagggaggcgggcccagtgcaggaggctgcatccctggcctgctggtgcccaccgggggctgtgcctgtgccgggccgcaggaagctggctgcccccattcctgctgctgctgctgctgctgctctgtggctgtttcaaagactgggcgaaaggctgtccggagggcagaccaggtgccttgccgcagagaaaacaccaaagtctcctgttcgctcataaagaagtttttgggatgggagagaatccagaccatcttggggcagccaggcccttgccttcatttttacagaggtagcacaactgattccaacacaaaaccccttcccctttttaaaatgatttctgttctaatgccatagatcaaaggcctcagaaaccattgtgtgtttcctctttgaagcaatgacaagcactttactttcacggtggtttttgttttttcttattgctgtggaacctcttttggaggacgttaaaggcgtgttttacttgtttttttaagagtgtgtgatgtgtgttttgtagatttcttgacagtgctgtaatacagacggcaatgcaatagcctatttaaagaactacgtgatctgattgagatgtacatagtttttttttttaccataactgaattattttatctcttatgttatcatgagaaatgtatgccaaatgattagttgatgtatgttttttaatttaatatttaaataaaatatttggaagg

SEQ ID NO: 13 - DNA, 972 bp, Homo sapiens
  modified_base (603)..(603): a, c, g, or t
tccacggtggcatccatgatgcatcgtcaggagactgtggagtgtttgcgcaagttcaatgcccggagaaaactgaagggtgccatcctcacgaccatgcttgtctccaggaacttctcagctgccaaaaacctattgaacaagaagtcggatggcggtgtcaagccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtttaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctnctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtcactaaaagtagatgttgaggctcttgaaaattctgctggtgctacatacattcggaagaagggtggaaaagttactggagatagtcaaccaaaggaacaaggacagggagatttgaaaaagtagcaaaaaaaaaaaaaaaaaaacttaaagctatcgattctgg

SEQ ID NO: 14 - DNA, 2716 bp, Homo sapiens
aggctgaggggcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccgccatggagccagagagggaagggaccgagagacaccccaggaaggtcagggaaggcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaaggttttcctgattgtgaaaactttttacttaccaaatgtaatggttctatagcagacaatagtcctctctttggacttgactgtgaaatgtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagaggttcttgagcaggccagagtggaaatccccctgtttcccttcagcattgttcagttctcttttaaggccttttcacctgtcctcactgaggagatgaacaaaaggatgaggatcaagtggacagagatatcaactgtctatgctgggccatttagcaaaaattgcaatctcagggctctgaagaggctgtttaaaagctttggcccagtccagtcaatgacttttgttcttgaaacccgtcagcctcatctctgtatacagtatgaagtcctagaagctgcccagctggccatagagtccttggatggtattctggtagatggtatctgcatcaaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagttttatggaaacttggtatagcagctaaaagagtttagtttgtttatatggcatgtataagttttcaataaatgcctaaagttcaagcataaaaaaaaaa

SEQ ID NO: 15 - DNA, 3508 bp, Homo sapiens
  modified_base (2673)..(2673): a, c, g, or t
  modified_base (2688)..(2688): a, c, g, or t
  modified_base (2695)..(2695): a, c, g, or t
  modified_base (2705)..(2705): a, c, g, or t
  modified_base (2708)..(2708): a, c, g, or t
  modified_base (2716)..(2716): a, c, g, or t
  modified_base (2724)..(2725): a, c, g, or t
  modified_base (2728)..(2728): a, c, g, or t
  modified_base (2757)..(2757): a, c, g, or t
  modified_base (2759)..(2759): a, c, g, or t
  modified_base (2763)..(2763): a, c, g, or t
  modified_base (2772)..(2772): a, c, g, or t
  modified_base (2784)..(2784): a, c, g, or t
  modified_base (2788)..(2788): a, c, g, or t
  modified_base (2794)..(2794): a, c, g, or t
  modified_base (2801)..(2801): a, c, g, or t
  modified_base (2805)..(2805): a, c, g, or t
  modified_base (2818)..(2818): a, c, g, or t
  modified_base (2828)..(2828): a, c, g, or t
  modified_base (2840)..(2840): a, c, g, or t
  modified_base (2861)..(2861): a, c, g, or t
  modified_base (2864)..(2865): a, c, g, or t
  modified_base (2934)..(2934): a, c, g, or t
cccaattccgccctgcccccgccgcggcggcgctagccgccactgagggaccgaccctataaaggccgctccgcgaggggtgcgcagcattcggcagagggcgccttcgacgggctgggctgtgcgcctgcgcagtgtgggtcgctcccgattccctgccccggccggccccgcctcggctccgcaccctcgccccgctctcagccgccgctctgccccgcagcagccagccccgtgtccggcagtatgttcagctgggtcagcaaggatgcccgccgcaagaaggagccggagctcttccagacggtggctgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaaccggtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggattgttgggaccgcatcatcctgctcttcgacgcccacaagcaggacatctcccatgagttctcggaagtgatcaaggctctgaagaaccatgaggacaagatccgcatggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctgggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagccctcctacgacgagatcttctacacgctgtcccctgtcaacggtaagattacgggtgccaatgttaagaaggagatggtgaagtccaagctccccaacaccgagctagggaagatctggaagctggccgacgtggacaaggacgggctgctggacgacgaggagttcgcgctggccaaccacctcatcaaggtcaagctggagggccacgagctgcccgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatataacgttagaggctgcgttctttgtcgccgcctcccctgtgtgccagccctgtgtgcacggcctctgccccccggcctttgctgtggctggagctggacagtgcagcgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaactgtgaatttttgtctccccttcccaccctccaaccaaggaacaaccctgcccagggggntaattaaggagtggnataacgnggggggattnacnccctttanccggaacnnganggcttgtaattttcctgaattgatggaangntttnttcaattcnccagcttcgttnccanaaaccntattaanttanagtgagagctctnggggaacccnaccctccgaacntttgggggagggttggtcggngcnnttggcaacccggcgggggccctaaacggacaagccccagtgatgggcaaagaatatgccagaggtcctngataccttttaagcccaagacaagggggagcagggacaaaaccagcccaatatgtaatcccctctcatttcctaccttccttcctcctctgtttagcaaaggagggcagctcacttggatgtccttacaacgcccctggcccccaggttgagcaataagaaaccagaaccttgcgcccagtggcccgggccagttcaggccgcctccccctcctctgcctggggccattgagcccagcctccagggcccgggcgcgtttgcagccagtggccactgtccgggctgtgatggcaccaaggcaggtggagcaccaggtaccacacagctgggcttcccaccaggctttcccgcgggggtctcagggagttctccccagcgctgcttgctcggagtctgcaggaactggccttgttctcctagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtgaaaaaaaaaa

SEQ ID NO: 16 - DNA, 1449 bp, Homo sapiens
tcatactggagagaagccctacgtttgtgaagaatgtggcaaagcctttaagtactcccgtatccttactacacataagagaattcatactgaagagaaaccatacaagtgtaataaatgtggcaaagcctttattgcatcctcaacccttagtagacatgagttcattcatatgggaaagaaacattacaaatgtgaagaatgtggcaaagccttcatttggtcctcagtcctaactagacataagagagttcatactggagagaagccctacaaatgtgaagaatgtggcaaagcctttaagtactcctctacccttagttcacataagagaagtcatactggagagaaaccctacaaatgtgaagaatgtggcaaagcctttgttgcatcctcaacccttagtaaacatgagatcattcatactggaaagaaaccctacaagtgtgaagaatgtggcaaagcttttaaccagtcctcatcccttactaaacataagaaaattcatactggagagaaaccctacaaatgtgaagaatgtggcaaagcttttaaccagtcctcttcccttactaaacataagaaaatccattctggagagaaaccatacgagtgtgataaatgtggcaaagcctttatttcaccctcaagccttagtagacatgagataattcatactggggagaaaccctagaagtgtgaagaatgtggcaaagccttcaagtggtcctcacaccttactatacactgagagttctgaacttactctgtaaccatcccaaactcctcccaggcacagtctggcagaggtcctgccatttcggagacctggaggaagtggcccatttacagccatgtaggcaggcctgcagaccttggcctttactacggtacctgaagtggttcaatgactcagtttcagttacctgagccacagcttaaggtcagttctgcctatatagaaacccacacagttaacctgaggaaatgctctctggtactcactgaaagccacactcatccacatcctgatacaaggcccaccatatgcagacctgactgccaaaacatgccctagtgtctgccgtacagagtgaagtcctgaaggatatttagtctgtccaaaactaaaatgaagatttcaactccccaaccccctctaacaagccagctaaaggtggactatagtgcagacccagcaaccttgtgaccaagctaaaacccctcatcactacaaattcagagggcatctcatcaccctaagggcccaacgaaagatctttaccttctaacatcagtttatgaaaacttgaaaaggtgtttgctccatcaaattcagacaccagtacaaaactatattatgcccattgtctggttctattttaatgtagcactggaagtgtgtggcagaagaattagtcaaagaaataaaaatagccattgaaattg

SEQ ID NO: 17 - DNA, 5605 bp, Homo sapiens
  modified_base (2235)..(2235): a, c, g, or t
  modified_base (2659)..(2659): a, c, g, or t
  modified_base (2667)..(2667): a, c, g, or t
  modified_base (3334)..(3334): a, c, g, or t
  modified_base (5256)..(5256): a, c, g, or t
ggagtgggccaggccgccagccccgccagccccgccagccccgccagccccgcgatggcttgggccgcgctcctcggcctcctggccgcactgttgctgctgctgctactgagccgccgccgcacgcggcgacctggtgagcctcccctggacctgggcagcatcccctggttggggtatgccttggactttggaaaagatgctgccagcttcctcacgaggatgaaggagaagcacggtgacatctttactatactggttgggggcaggtatgtcaccgttctcctggacccacactcctacgacgcggtggtgtgggagcctcgcaccaggctcgacttccatgcctatgccatcttcctcatggagaggatttttgatgtgcagcttccacattacagccccagtgatgaaaaggccaggatgaaactgactcttctccacagagagctccaggcactcacagaagccatgtataccaacctccatgcagtgctgttgggcgatgctacagaagcaggcagtggctggcacgagatgggtctcctcgacttctcctacagcttcctgctcagagccggctacctgactctttacggaattgaggcgctgccacgcacccatgaaagccaggcccaggaccgcgtccactcagctgatgtcttccacacctttcgccagctcgaccggctgctccccaaactggcccgtggctccctgtcagtgggggacaaggaccacatgtgcagtgtcaaaagtcgcctgtggaagctgctatccccagccaggctggccaggcgggcccaccggagcaaatggctggagagttacctgctgcacctggaggagatgggtgtgtcagaggagatgcaggcacgggccctggtgctgcagctgtgggccacacaggggaatatgggtcccgctgccttctggctcctgctcttccttctcaagaatcctgaagccctggctgctgtccgcggagagctcgagagtatcctttggcaagcggagcagcctgtctcgcagacgaccactctcccacagaaggttctagacagcacacctgtgcttgatagcgtgctgagtgagagcctcaggcttacagctgcccccttcatcacccgcgaggttgtggtggacctggccatgcccatggcagacgggagagaattcaacctgcgacgtggtgaccgcctcctcctcttccccttcctgagcccccagagagacccagaaatctacacagacccagaggtatttaaatacaaccgattcctgaaccctgacggatcagagaagaaagacttttacaaggatgggaaacggctgaagaattacaacatgccctggggggcggggcacaatcactgcctggggaggagttatgcggtcaacagcatcaaacaatttgtgttccttgtgctggtgcacttggacttggagctgatcaacgcagatgtggagatccctgagtttgacctcagcaggtacggcttcggtctgatgcagccggaacacgacgtgcccgtccgctaccgcatccgcccatgacacagggagcagatggatccacgtgctcgcctctgcccagcctgccccagcctgccccagcctcccagctttctgtgtgcacagttggcccgggtgcaggtgctagcattaccacttccctgcttttctcccagaaggctgggtccaggggagggaaaagctaagagggtgaacaaagaaaagacattgaaagctctatggattatccactgcaaagttttctttccaaaatcaggctttgtctgctcccaattcacctcgttactctcacctcgtgatatccacaaatgctattcagataaggcagaactaggagtcttcactgctctgcccccaactcccggaggtgtcaccttcctagttcttatgagctagcatggcccgggccttatccagtcaaagcggatgctggccacagaaaggccactcaggatgtcctttgtgtccattgatgtcattcagcagtcagtcccccaataatccttaaactagctaaaaccaaaggagtcccttagaagatctgcttccctggggccccatttgccagattgccccattgctcacactacttgagaaaatgcaggagagcttcccccaaggctgatgcattcccggtgcagaacaggggcaccctccaaacactgggctctgaggagtggagttctctgttctagagtnacaggcaccagatgggatgggctttctcagtgtcagcactcaggtagggagctaaggaagacacagcccagacaagatggctggaaggagccagccaggactccttagactgatcaagccaaaaaagaaggtgccgatttcatgcattctagtgcagaagccccaactgtgatcacgatccagtctgcagacgtgttttgtttggacttcacttaaaaaaatgccttagttgttatcatctttgggagagttcattcaaaatgtccagcttctcttgaaaacttggtatatctggccacactgggctcacattcccaagggtaactcttggccagagctgagtggcagccgcctcccttatgcaggacatgtgctctcggcttcaccagggttctgaccgggtctgcttctgcattcacagcgnctcctggncctgaaggcatctgagtgtgagaccctgttctaactcttagaagtgacattgtaagaggtggtggggaccagctaattggtccaacccagcctgagtgcaccaccctttgaacaaatgtatcagtgatgaaaatttgcctttgccccggcttgcctgtaatcccagcactttgggaggccgaggtgggcggatcacttgaggtcgggagttcaagaccagcctggccaacatggcgaaaccccgtctctactaaacataaaaaaattagtcaggtgtggcggtgccgtgcctgtaatcccagctattcaggaggctgaggcaccagaattgcttgaacccaggaggtggaggttgcagtgaactgaagactgcgccacggcactccagcctgggcgacagagcaagactctgtctcaataaataaataattaattaaaataaaaaacagcttaaagagaaaaatggcctgcaaaccttttttatgatgctatttttattaatataaagtcctgtttattgagaccctttaaatgcctgcgagagaccctacagacagtatgtctactcctcacagcatctctatgaagagaaggagggttgtgcccacttcatagatgagaaaactgagaggtgaggtgacttgcctggggccacatagctcataanctgtagaactctgcaggcagatttactgtcccaggagcaaatgctggatgagcaactcctgttctttgggctcaaggggactggtgatgggacaattcttctcgacttcaggagctgacagagccagaggcacctaaacttgggtacatcttgtaagacacataatgaggtccctctagctttagctggagggagataaaagaaccccagacctctgaatgtcccagaggctagtctcttctcagagcagcactggggtttgggggcttccctgggcctcagcctccaggcacccccaggattcccagagagacgctgtgattggcaggaggcaggatatccccagggaaacccatcttcacgcctgggtgacccccactgccgcctccttcttaactctgcaggaaatcagagctggcagcctccagtgggaggacagagccggtttccgtggcaaccctcagctgcctcatcgtggctgggaagggaaggaagcaagccggcagaaatagctatggaaggtcttgcgcaggctgcaaccctggtgtgctgggcgaaaacccttatgactccccccttccaaatcaggctgggttgtcactgagactagattctcacctgccttcaaagaagggccaattccctttaaaggtcgcacctccttggaaccacagtcattagtgaattacactcaaggaaaagatgtgctcccaccaggcagctccagctgttacctgagatactgaagtgcagctcaggagacgattatttaaacctgcccttgttttaatcgttatttttctctttaaaaaaaatagaagctataaagaaaagagggagagatgagtgggttagctacctgctatgcgctagttaggaagttacctggatgccattgtatttcttcatcccttgcttaagaatcaaaattactggacatatgttaggaatactctttctttctttctttctttttaagctcagtggcaagaatgaaatactctttttttttttttttttttgagatggagtctcgctctgctgcccaggctagagtgcagtggcgtgatctcggctcactgcaagctctgcctcccgtgttcacaccattctcctgcctcagcctcctgagtagctgggactacaggcacccgccaccacacccggctaatttttggatttttagtagagatgggatttcaccgtattagccaggatggtcttgatctcctgagctcgtgatctgcccgcctcggcctcccaaagtgctgggattacaggtgtgagccaccgcgcccagccaagaataaaatactcttaagttgatctaatgaagtgtttccttaccattgtgattattgttactattatttgctatattttaatattgttgtttaccaaatattctcctttaaacagactcgctttttaaacttttttttttttttttgagacggagtttcacgcttattgcccaggctggagtgcaatggcacgatctcagctcaccacaacctccacctcctgggtttaagcaatgcttctgcctcagcttcccaagtagctgagattacaggcgcacaccaccacggccaactggtttttgtatttttagtagagacggggttcccccatgttggtcaggctggtctcgaaactcctgaccctcgtgatttgcctgcctggggcctcccaaagtgctaggattacaggcatgagccaccatgcccggcctaaactttgtttttaaaatgaactttttttccccccaattgctgccaatagtggataacatgtatcactcactgccaaaaatagaaagtgaccatgaaaaataaattcgctggggaagggggctccatgctggtgtggccaaggctgagagctctctcttctctgttacaaaacgagataagcaagtnttagaattgccttaaggccacactggcatctccctgaccttctccagggacagaagcaggagtaagtttctcatcccatgggcgaccagggccatctcctcccaccagtggcccccactcacagggagctggcaatgccctacctgcctgttctccagatggagaaacaggctctgagatttcacaggtcttgcccaaagtcattgattttaatgattaaaaagaataaacacagtgtttcctgagtagcagtgattgttatgccttgctattttaataaagattctattttcgtataacattgtcaagtggaaacatgctgaaatctattaaaccatctttgtttgtg

SEQ ID NO: 18 - DNA, 1781 bp, Homo sapiens
ggcacgaggggtggtggcagaggcgcctgcggttactggccgggccgacgggtcctgagtctccagagctcggtgaggcgtcccggaggcggcgatcacggttcttacatccccgcgtccccaggtttagcctgagcagggttgtggaaggccgggacccattgacagcacgatggtgacggagcaggaggtggatgccatcgggcagacgctggtggaccccaagcagcccctgcaggcccgcttccgggcgctgttcacgctgcgtgggctcggcggcccaggcgccattgcatggatcagccaggccttcgatgacgattccgccctgctcaagcacgagctggcctactgcctgggccagatgcaggatgcccgcgccatccccatgctggtggacgtgctgcaagacacccgtcaggagcccatggtgcgccatgaggcaggggaggccctgggggccatcggggacccggaagttctggagatcctgaagcagtattcctcggaccccgtcatcgaggtggccgagacctgccagctggccgtgcgcaggctggagtggctgcagcagcacggcggggagccggcggcgggaccctacctctccgtggaccctgccccgccggctgaggagcgtgacgtggggcgcctgcgggaggcgctgctggatgagtcccggccgctcttcgagcgataccgcgccatgttcgccctgcgcaacgcgggaggcgaggaggccgccctggcgctggccgagggtctgcactgtgggagcgccctcttccgccacgaggtcggctacgtcctgggacagctgcagcacgaggcggcggtgccccagctggcggccgccctggcccgatgcaccgagaaccccatggtgcggcacgagtgcgcggaggccctgggcgccattgcccggcccgcctgcctggccgcgctgcaggctcacgcggacgacccagagcgcgtggtgcgtgagagctgcgaggtggctctggacatgtatgagcacgagaccgggcgggccttccagtacgcggacggcctggagcagctgcgcggggccccctcctagggccccaccctcacccggagctcccggaggactcttgagggccgctcctcccccgcagagctttggcgtctaaaccgggtgtgtgtaaatcggtgtcatcgcttgtgtcttgctgggcgcacggttgctgtccccctcctccgtctgggaccgaggagctgccgttgtgctgtgactccctgagtcccctgactgctcctcggggcctggcgcagggctgtagcgtggaagtttccaggcttggggtgggactctgcgggaggctctgggatgcccggctcaggacaggggaggattgcgagggaagccaggggaggatcgcgagggaagccaggggaggatcgcgagggaagccaggggaggatcgcgagggaagccaggggaggatcgcgagggaagccaagggaggatcgcgaggggagccaggggaggatcgcgagggaagccaggggcagagctggggctctgggaagaggctgacgttatggtggcttcagcttcactaggaatgggacacagggtctgggggcctctgactcccccaccccgaggcctgggtagggacagggtggtggtccctgggtgggtcaggtagggcacaggggccagggagggacaagcagacctcagagcgctgcccagatggaatattaaattatttttgccaaaacaaaaaaaaaaaaaaaaaaaaaaaaaaaaa

SEQ ID NO: 19 - DNA, 1890 bp, Homo sapiens
cttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaacttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatggattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagagctttgataacaagataatgctggctgcataaaactagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgctgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagtccatttcttttgtgaatgtgctaaataaaaagtgttattaattgctggttca

SEQ ID NO: 20 - DNA, 1056 bp, Homo sapiens
aagctgcactcctcaggcttccggtcttgtggaccgaggctcctctccaatcgtcctaaagcaactgaaggaacaattgataacaatttaaacatgttaatttatttaatctgatttggttgttaaaacagccttaaaactctcattcctatttcccagcaattgcaagagacgcctccgcggagccggcgctcagatgccaaaggctggagtcgttggtgacgtcatccagggctgggctatgcggggtggggccaagaagcaggaccaaagttccggtatgcgcgctttcagtcttcaattaggtccgaattcccggcatataagggcgttgctttgccttggcgtttaggtttcttaagttggttttagaagttgcttagtcatgtctggccgtggtaaaggtggaaaaggtttgggtaagggaggagctaagcgtcatcgcaaggttttgcgcgataacatccagggcatcactaagccagctatccggcgccttgctcgtcgcggcggtgtcaagcgaatttctggccttatctatgaggagactcgtggtgttctgaaggtgttcctggagaacgtgattcgtgacgctgtcacttacacagagcacgccaaacgcaagaccgtgacagcaatggatgtggtctacgcgctgaagcgacagggacgcactctttacggcttcggtggctaaggctcctgcttgctgcactcttattttcattttcaaccaaaggcccttttcagggccgcccacttttttcataaaagagcagacatcttgttatcctgctttgttccagatttttgctgagaagtagttactgtgcacatgtgtagatttgcaggtaacgtttaattactcgtgcttaatctcgcatgtttaggatttgggcataaagtagttaaagccactgttttctgcttgagggaagttggtatgttgaatatgtttagctttcttgtggcattttaacactagatatcagtgagtaagctggattgtgacagtttataattcccgtgggccttcctccttcagtttaagctgac

SEQ ID NO: 21 - DNA, 623 bp, Homo sapiens
atggcaggaaaatcttcactttttaaagtaattctctttggagatggtggagttggaaagagttatcttatgcacagatatgtaattaataggtttgatacccagctctttcatacataggtgtggaatttttaagtaaagatttggaagtggatggacattttggtaccaagtagaattgggacacagcaggtcaggagcgattctgaagcctgaggatgccattttacagaggttctgactgctgcctgcttacttttagtgttgacaattccaaagcttccagaacttaagtaactggaagaaagaattcttatatttcgctgatgtgaaagaacccaaaagctttccttttgtaattttgggtaacaagactgacagtgaacagcaggtgtctgcagaagaagcccaagcctggtgcagggacggcagcgactatccttaatttgaaacaagtgcaaaagatcgtcaaatgtggcagtagcatttgaaaagggggttccaagagttcttactaccagggataggtcagatcacttgactcagagagtgatggtctgacttcatcgaaaccattggtcaatcttcattgaaagcccaagcctagctcatcttgctgttga

SEQ ID NO: 22 - DNA, 3727 bp, Homo sapiens
gtcgcggtgtgctaagcgaggagtccgagtgtgtgagcttgagagccgcgcgctagagcgacccggcgagggatggcggccaccgggaccgcggccgccgcagccacgggcaggctcctgcttctgctgctggtggggctcacggcgcctgccttggcgctggccggctacatcgaggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggagatgtatccagagctacagatcacaaatgtgatggaggcaaaccagcgggttagtattgacaactggtgccggagggacaaaaagcaatgcaagagtcgctttgttacacctttcaagtgtctcgtgggtgaatttgtaagtgatgtcctgctagttccagaaaagtgccagtttttccacaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgattcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaagacactcagccggagttgtaccacccaatgaaaaaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaggggccgcggctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaaaaatctgaaggttctggtaacctgtggtgtatttttattttcctgtgactgtttttgttttgtttttttcctttttcctcccctttagccctattcatgtctctacccactatgcacagattaaacttcacctacaaactccttaatatgatctgtggagaatgtacacagtttaaacacatcaataaatactttaacttccaa

SEQ ID NO: 23 - DNA, 2087 bp, Homo sapiens
gcgagaagagcagacaccgtgctcctggaatcacccagcatgttgcaaggtctcctgccagtcagtctcctcctctctgttgcagtaagtgctataaaagaactccctggggtgaagaagtatgaagtggtttatcctataagacttcatccactgcataaaagagaggccaaagagccagagcaacaggaacaatttgaaactgaattaaagtataaaatgacaattaatggaaaaattgcagtgctttatttgaaaaaaaacaagaacctccttgcaccaggctacacggaaacatattataattccactggaaaggagatcaccacaagcccacaaattatggatgattgttattatcaaggacatattcttaatgaaaaggtttctgacgctagcatcagcacatgtaggggtctaaggggctacttcagtcagggggatcaaagatactttattgaacctttaagccccatacatcgggatggacaggagcatgcactcttcaagtataaccctgatgaaaagaattatgacagcacctgtgggatggatggtgtgttgtgggcccacgatttgcagcagaacattgccctacctgccaccaaactagtaaaattgaaagacaggaaggttcaggaacatgagaaatacatagaatattatctggtcctggataatggtgagtttaaaaggtacaatgagaatcaagatgagatcagaaagagggtatttgagatggctaattatgtcaacatgctttataaaaagctcaatactcatgtggccttagttggtatggaaatctggactgacaaggataagataaagataaccccaaatgcaagcttcaccttggagaatttttctaaatggagggggagtgttctctcaagaagaaagcgtcatgatattgctcagttaatcacagcaacagaacttgctggaacgactgtgggtcttgcatttatgtctacaatgtgttctccttattctgttggcgttgttcaggaccacagcgataatcttcttagagttgcagggacaatggcacatgaaatgggccacaactttggaatgtttcatgacgactattcttgcaagtgtccttctacaatatgtgtgatggacaaagcactgagcttctatatacccacagacttcagttcctgcagccgtctcagctatgacaagttttttgaagataaattatcaaattgcctctttaatgctccattgcctacagatatcatatccactccaatttgtgggaaccagttggtggaaatgggagaggactgtgattgtgggacatctgaggaatgtaccaatatttgctgtgatgctaagacatgtaaaatcaaagcaacttttcaatgtgcattaggagaatgttgtgaaaaatgccaatttaaaaaggctgggatggtgtgcagaccagcaaaagatgagtgcgacctgcctgaaatgtgtaatggtaaatctggtaattgtcctgatgatagattccaagtcaatggcttcccttgccatcacgggaagggccactgcttgatgggcacatgccccacactgcgggagcagtgcacagagctgtggggaccaggtaggaggacaaatcctttcccctgtgcatgtgcgaaggaaaatcatttcagatgacagtgtttaaccatggtcaaaagaccattctgtcctatccttcttagaagcttcgaactcaaaatcatggaaaggttttaagatttgaggttggttttagggttgctagatttagcaagtaaaaataaggatggccccgttaaattttaacttaaaattaacaagttttttgttaattttttgttttttgtctcagcatcagtatatcccatgcaatatttgaggtgtgctcatactaaaattatttgtgtatctgaaattcaaattaaactgggtgtctttttcttttcatctggcaaccctactaagatcataaacccttggaaatctgtgtgtgtgcgggtgtgtgtgtgtgtgtgtgtgcaggggtggcagaagtactgtgggatgggacagaaataaaaaaaaaaaaaaaaaaaaaaaaa

SEQ ID NO: 24 - DNA, 665 bp, Homo sapiens
agaggaaagaaccctgggaacgggaggcgaagggataatgagctggggatgggagcagtcgcaggaagaatcctctgcctggagccggcagactccaacccctcagcttgagactcaggagccccatagtccccacagcaataagaagcaccagctcctggtcccgaaaaaaggagggccccaactccagggactgcggcccgccctggagctgagaacacgcggactccagggagaggacagggcttcagggacccgagagccgctctgagcaccgggggatgtgactgcctcagcggcagagctggaagggccctcgaatgccattcacaggaacagcccaggaacccagggacttcagaaggtttgtccgaaaagtgagaggaggcggaggagagagcctgcgaggtcaagctgcagagaacatgagcttctacctccagatgtgccagggtgcatctcaataaacttggattttggccaggcgcggtggctcaggcctgtaatcccagctctggaagctgaaggatagcttgagcccaggagttcgaggctgcagtgagctatgatctcaccactacactccagcctgggtgacagcaagagatcttgtctcagaaataaataaataaaatttaaaaataaaaaaaaaaaaaaaaaaaaaa

SEQ ID NO: 25 - DNA, 1987 bp, Homo sapiens
ctcgagagctccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattgtcggctccgacctgggacccctcatggtgactgaagcccttaagccatactcttcaggaggtccccgcgtctggtatgtctccaacattgatggaactcacattgccaaaaccctggcccagctgaacccggagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaacaaagatgccacggaggaggt

SEQ ID NO: 26 - DNA, 1374 bp, Homo sapiens
gaataagccttcgataattatgaagggtgtttcggtatcttccctccaaaatgctaagaaataatttaggcaacagttcagactctaaaaatgaagatggctcggtcttttcacagactgaacacaatattgttgcaacttacttgattatggcaggtatgataagtattatcagcaacataatagttctgggcatcttcattaagtacaaggaacttcggacacccacaaatgcaattattattaacctggctgttactgatataggggtcagtagcattggctatcccatgtctgctgcctcagatctgtatggaagttggaaatttggatacgcaggctgtcaggtttatgctggattgaatattttttttggaatggcaagcattggattactcacggtcgtggctgtggaccgatacctgaccatctgccttcctgacgtagggagaagaatgaccaccaacacttacatcggcttgattctgggagcctggatcaatggcctgttttgggctttgatgcctatcatagggtgggctagttatgccccagatcctactggtgctacgtgtaccataaactggaggaaaaatgatagatcttttgtgtcttacaccatgacagttattgcgataaattttattgtgcccttgacagtgatgttttactgctattaccatgtcacgctatccattaaacatcacactaccagtgactgcactgagtccctcaacagagactggtcagatcagatagatgtaacaaagatgtctgtgatcatgatctgcatgtttctggtggcatggtccccttattccatcgtgtgcttatgggcttcttttggtgacccaaagaagattcctccccccatggccatcatagctccactgtttgcaaaatcttctacattctataacccctgcatttatgtggttgctaataaaaagtttcggagggcaatgcttgccatgttcaaatgtcagactcaccaaacaatgcctgtgacaagtattttacccatggatgtatctcaaaacccattggcttctggaagaatctgaaataagagaaaaggacacgctatcaaaacactttagttttttgacaatgcttttcttttaaatatgagcccatttagatcaagtgcagacatggatcattgtcctatgagagtgtaagctcctcaagcacagctcgtgcttccgtttgtgcactctggctgctgtagtgtatgcttctctgtgtcctgatatatcaacttattgctcatctcctttgatgaattaggcatcagaggttaaggtcccctttctttctccctattatggcatgcattacactgtactgatgacctttaacttgcctggctcc

SEQ ID NO: 27 - DNA, 2513 bp, Homo sapiens
gtcactcagcctatggagatgaagaaactgaggttcagagaggttaagagactccactgaggtcacacagccgatgacagacaaccttctgtgccttcatcaagctggttgtgtacccaccatgtccctggcgacaggattgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttattttctttggatgtgaaaggaaatcactggttaaagcttgatcgagagacattatcagctctttaaggattgcaggagaataggctactttattttctgaaaaggtaaatatatgcaagcaaagccaacatgccacgaatggcgttggtctaccacacagccgtgtctgggacacagttgggggtcatcccccagcaggagtgaagtcgagcttagcggcccttgtgtcctcccttggaattcctgccatcccttttgattgagcctccacctctgggatttttcttccatttttctcctctcttaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcctggttcgatgagaggttcaaccagaccatgcagccgctgctgactgcccagaacgcgctcttggaggacgacacctaccgatggtggctgaggctccagcgggagaagaagcccaataacttgaatgacaccatcaaggagctgttcagagtggtgcctgggaatgtggaccctatgctggagaagaggtcggtgggctgccggcgctgcgctgtggtgggcaactcgggcaacctgagggagtcttcttatgggcctgagatagacagtcacgactttgtcctcaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttcccacacctacatcccggttcctgcaaagatcagagtgaaacaggataagatcctgatctaccacccagccttcatcaagtatgtctttgacaactggctgcaagggcacgggcgatacccatctaccggcatcctctcggtcatcttctcaatgcatgtctgcgatgaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttgacagcatctactcagcaaggtcactaagctctgccagcgtggcagagcatgtcttggaacctgtcttgagtgggacaacgtccccccactgctgccctagagctggggagacgctcagggaaaggttcaacctccacacactaaaatcatttgctcctgggcaagcttgggaatgaatgtggaagatcctatattctgagagacaggacagtttcccaggaagatgggcagagacttgagtggcgattacctccagcacagagacgtgccaggcggtgttggcgctcggggcgagatgctgcccttcttttgcacgaagcctggcctcttgcttggcgtgataaccctgtcatcttcccaaagctcatttatgagccaccagaggctcctaccccaaagatttcacagaaacttgaggccaggtgccgtggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacaccactgcactccagcctgggaacaag

SEQ ID NO: 28 - DNA, 1737 bp, Homo sapiens
gtggtcaccttccccagctagaaagccttctttttatatcaacttccttttaattatgaagtattacaatcaagcataaagacataataaatgttaacatctttcctttgtgtctgtttaaaaaatgtttcttattacagaaaatttcaaatagatttaaagtagagaaatgcacgtgatgaaaccccatgcacttgccattccatttcaatagttattacttcacggaagagttggcaatgatgagaacatgtcaaacacctggaaattcctgtctcattcaacagactcactaaataaaatcagcaaggtcaatgagtcaacagaatcacttactgatgagggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcagatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctttccgggaatggatggaggtgctttaactgatgcgagtctcacagagtcctatttcagcaccagctttattggagtcaatggatttggaagccctgtagaaacaaagtatcccttgatgcagtacactctggttgtcttccaacgtcttcgggtctgcacctctggattcagcaataccaaaaacaccggcccccaaacttcccacctacttgaaccaataaacttcctcttgtgtttaaact

SEQ ID NO: 29 - DNA, 629 bp, Homo sapiens
tgggagggagccatgaagcattacgaggtggagattctggacgcaaagacaagggagaagctgtgtttcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactgcacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcagctcacccctgctgaggctcagcccctcaacccggtggcattctgggggaggagtggggcccacagctctccagcacccggaataaagcccgcctgtccccagtcggaacaaaaaaaaaaaaaaaaaaaaaaaaaaaaaa

SEQ ID NO: 30 - DNA, 3113 bp, Homo sapiens
aaaaagtacagagtccagggaaaagacttgcttgtaactttatgaattctggatttttttttttcctttgctttttcttaactttcactaagggttactgtagtctgatgtgtccttcccaaggccacgaaatttgacaagctgcacttttcttttgctcaatgatttctgctttaagccaaagaactgcctataatttcactaagaatgtcttctaattcagatactggggatttacaagagtctttaaagcacggacttacacctattgtgtctcaatttaaaatggtgaattactcctatgatgaagatctggaagagctttgtcccgtgtgtggagataaagtgtctgggtaccattatgggctcctcacctgtgaaagctgcaagggattttttaagcgaacagtccaaaataataaaaggtacacatgtatagaaaaccagaactgccaaattgacaaaacacagagaaagcgttgtccttactgtcgttttcaaaaatgtctaagtgttggaatgaagctagaagctgtaagggccgaccgaatgcgtggaggaaggaataagtttgggccaatgtacaagagagacagggccctgaagcaacagaaaaaagccctcatccgagccaatggacttaagctagaagccatgtctcaggtgatccaagctatgccctctgacctgaccatttcctctgcaattcaaaacatccactctgcctccaaaggcctacctctgaaccatgctgccttgcctcctacagactatgacagaagtccctttgtaacatcccccattagcatgacaatgccccctcacggcagcctgcaaggttaccaaacatatggccactttcctagccgggccatcaagtctgagtacccagacccctataccagctcacccgagtccataatgggctattcatatatggatagttaccagacgagctctccagcaagcatcccacatctgatactggaacttttgaagtgtgagccagatgagcctcaagtccaggctaaaatcatggcctatttgcagcaagagcaggctaaccgaagcaagcacgaaaagctgagcacctttgggcttatgtgcaaaatggcagatcaaactctcttctccattgtcgagtgggccaggagtagtatcttcttcagagaacttaaggttgatgaccaaatgaagctgcttcagaactgctggagtgagctcttaatcctcgaccacatttaccgacaagtggtacatggaaaggaaggatccatcttcctggttactgggcaacaagtggactattccataatagcatcacaagccggagccaccctcaacaacctcatgagtcatgcacaggagttagtggcaaaacttcgttctctccagtttgatcaacgagagttcgtatgtctgaaattcttggtgctctttagtttagatgtcaaaaaccttgaaaacttccagctggtagaaggtgtccaggaacaagtcaatgccgccctgctggactacacaatgtgtaactacccgcagcagacagagaaatttggacagctacttcttcgactacccgaaatccgggccatcagtatgcaggctgaagaatacctctactacaagcacctgaacggggatgtgccctataataaccttctcattgaaatgttgcatgccaaaagagcataagttacaacccctaggagctctgctttcaaaacaaaaagagattgggggagtggggagggggaagaagaacaggaagaaaaaaagtactctgaactgctccaagcaacgctaattaaaaacttgctttaaagatattgaatttaaaaaggcataataatcaaatacttaatagcaaataaatgatgtatcagggtatttgtattgcaaactgtgaatcaaaggcttcacagccccagaggattccatataaaagacattgtaatggagtggattgaactcacagatggataccaacacggtcagaagaaaaacggacagaacggttcttgtatatttaaactgatctccactatgaagaaatttaggaactaatcttattaattaggcttatacagcgggggatttgagcttacaggattcctccatggtaaagctgaactgaaacaattctcaagaatgcatcagctgtacctacaatagcccctccctcttcctttgaaggcccgagcacctctgccctgtggtcaccgaatctgtactaaggacctgtgttcagccacacccagtggtagctccaccaaatcatgaacagcctaattttgagtgtctgtgtcttagacctgcaaacagctaataggaaattctattaatatgttagcttgccattttaaatatgttctgagggttgttttgtctcgtgttcatgatgttaagaaaatgcaggcagtatccctcatcttatgtaagtgtgaattaatattaagggaaatgactacaaactttcaaagcaaatgctccatagctaaagcaacttagaccttatttctgctactgttgctgaaatgtggctttggcattgttggatttcataaaaaatttctggcaggaagtcttgttagtatacatcagtctttttcatcatccaagtttgtagttcatttaaaaatacaacattaaacacattttgctaggatgtcaaatagtcacagttctaagtagttggaaacaaaattgacgcatgttaatctatgcaaagagaaaggaaaggatgaggtgatgtattgactcaaggttcattcttgctgcaattgaacatcctcaagagttgggatggaaatggtgatttttacatgtgtcctggaaagatattaaagtaattcaaatcttccccaaaggggaaaggaagagagtgatactgacctttttaagtcatagaccaaagtctgctgtagaacaaatatgggaggacaaagaatcgcaaattcttcaaatgactattatcagtattattaacatgcgatgccacaggtatgaaagtcttgccttatttcacaattttaaaaggtagctgtgcagatgtggatcaacatttgtttaaaataaagtattaatactttaaagtcaaaaaaaaaaaaaaa

SEQ ID NO: 31 - DNA, 5190 bp, Homo sapiens
ccagaagttctccagggcttccgcagagcactttttcgctgcctgtgagctgcagcgcgggagagctcgggctcgcgcggaccccagcgcctggcaggctgacagcgctctctcgccccaggtgcccgcgcgcgtggtgagcagctgcaccaggtggcgtccggggtggggtcaatgaagtgcagcctgaggaagatgtggcgccctggagaaaagaaggagccccagggcgttgtctatgaggatgtgccggacgacacggaggatttcaaggaatcgcttaaggtggtttttgaaggaagtgcatatggattacaaaactttaataagcaaaagaaattaaaaacatgtgacgatatggacaccttcttcttgcattatgctgcagcagaaggccaaattgagctaatggagaagatcaccagagattcctctttggaagtgctgcatgaaatggatgattatggaaatacccctctgcattgtgctgtagaaaaaaaccaaattgaaagcgttaagtttcttctcagcagaggagcaaacccaaacctccgaaacttcaacatgatggctcctctccacatagctgtgcagggcatgaataatgaggtgatgaaggtcttgcttgagcatagaactattgatgttaatttggaaggagaaaatggaaacacagctgtgatcattgcgtgcaccacaaataatagcgaagcattgcagattttgcttaacaaaggagctaagccatgtaaatcaaataaatggggatgtttccctattcaccaagctgcattttcaggttccaaagaatgcatggaaataatactaaggtttggtgaagagcatgggtacagtagacagttgcacattaactttatgaataatgggaaagccacccctctccacctggctgtgcaaaatggtgacttggaaatgatcaaaatgtgcctggacaatggtgcacaaatagacccagtggagaagggaaggtgcacagccattcattttgctgccacccagggagccactgagattgttaaactgatgatatcgtcctattctggtagcgtggatattgttaacacaaccgatggatgtcatgagaccatgcttcacagagcttcattgtttgatcaccatgagctagcagactatttaatttcagtgggagcagatattaataagatcgattctgaaggacgctctccacttatattagcaactgcttctgcatcttggaatattgtaaatttgctactctctaaaggtgcccaagtagacataaaagataattttggacgtaattttctgcatttaactgtacagcaaccttatggattaaaaaatctgcgacctgaatttatgcagatgcaacagatcaaagagctggtaatggatgaagacaacgatgggtgtactcctctacattatgcatgtagacaggggggccctggttctgtaaataacctacttggctttaatgtgtccattcattccaaaagcaaagataagaaatcacctctgcattttgcagccagttatgggcgtatcaatacctgtcagaggctcctacaagacataagtgatacgaggcttctgaatgaaggtgaccttcatggaatgactcctctccatctggcagcaaagaatggacatgataaagtagttcagcttcttctgaaaaaaggtgcattgtttctcagtgaccacaatggctggacagctttgcatcatgcgtccatgggcgggtacactcagaccatgaaggtcattcttgatactaatttgaagtgcacagatcgcttggatgaagacgggaacactgcacttcactttgctgcaagggaaggccacgccaaagccgttgcgcttcttctgagccacaatgctgacatagtcctgaacaagcagcaggcctcctttttgcaccttgcacttcacaataagaggaaggaggttgttcttacgatcatcaggagcaaaagatgggatgaatgtcttaagattttcagtcataattctccaggcaataaatgtccaattacagaaatgatagaatacctccctgaatgcatgaaggtacttttagatttctgcatgttgcattccacagaagacaagtcctgccgagactattatatcgagtataatttcaaatatcttcaatgtccattagaattcaccaaaaaaacacctacacaggatgttatatatgaaccgcttacagccctcaacgcaatggtacaaaataaccgcatagagcttctcaatcatcctgtgtgtaaagaatatttactcatgaaatggttggcttatggatttagagctcatatgatgaatttaggatcttactgtcttggtctcatacctatgaccattctcgttgtcaatataaaaccaggaatggctttcaactcaactggcatcatcaatgaaactagtgatcattcagaaatactagataccacgaattcatatctaataaaaacttgtatgattttagtgtttttatcaagtatatttgggtattgcaaagaagcggggcaaattttccaacagaaaaggaattattttatggatataagcaatgttcttgaatggattatctacacgacgggcatcatttttgtgctgcccttgtttgttgaaataccagctcatctgcagtggcaatgtggagcaattgctgtttacttctattggatgaatttcttattgtatcttcaaagatttgaaaattgtggaatttttattgttatgttggaggtaattttgaaaactttgttgaggtctacagttgtatttatcttccttcttctggcttttggactcagcttttacatcctcctgaatttacaggatcccttcagctctccattgctttctataatccagaccttcagcatgatgctaggagatatcaattatcgagagtccttcctagaaccatatctgagaaatgaattggcacatccagttctgtcctttgcacaacttgtttccttcacaatatttgtcccaattgtcctcatgaatttacttattggtttggcagttggcgacattgctgaggtccagaaacatgcatcattgaagaggatagctatgcaggtggaacttcataccagcttagagaagaagctgccactttggtttctacgcaaagtggatcagaaatccaccatcgtgtatcccaacaaacccagatctggtgggatgttattccatatattctgttttttattttgcactggggaaataagacaagaaataccaaatgctgataaatctttagaaatggaaatattaaagcagaaataccggctgaaggatcttacttttctcctggaaaaacagcatgagctcattaaactgatcattcagaagatggagatcatctctgagacagaggatgatgatagccattgttcttttcaagacaggtttaagaaagagcagatggaacaaaggaatagcagatggaatactgtgttgagagcagtcaaggcaaaaacacaccatcttgagccttagctcctcagaccttcagtgaggcttctaatggggggtgcatgacttgctggttctaactttcaatttaaaaagagtgaggaagaagcagaatgattgattttactgcgtgtgaaatcatggttcctgcatgctatataaaagtaaaccatcttttatcctctattcatattttctaccaatcactatgtattggggatatctttgcagatatgttcaaattggactggactttgatgagatataatctcattatttgaatgggtagaaaatgaatttgctagaacacacatttttaatgaaaagaagtaataaatgtaactattaagctaaaatgcaaatgtcagtactgaattcctgcttgttaattacataatatgtgatgctctagaaaatagtcacaagtattaataatgccttagatgatagtcttaaatattaggttgaggtctacctaacctaagctgcttcctggaaagcttcatgttgaaagaacctatgggtggcaccatgtggacttttctgtccctactgtgatgaatagccccacccttcttgctgtccccaacacacctgatgtcactttgagccatatagttgaagtacaaattaataggccttatgatatgcacgaattttactatagataatatatgttgtttctggttttgtttgccaatgagcataataaatgtaaaacctatatagtatccctgtgattattgtatgagcctttgtttgagatttgaaaaaaacatggctccatcacatattcccttttttcttttgatgtctactcaaatcatgaattaatcacatacctcatcattaatcttttcaaggtccttctattgttttgtctgattttctccatcatcctgattagcatgtttattccctcactacccccaggagatattcactgtaatgaatatgtctttggctatgtatgtgtccttgtgttatgttgtacagtgttgttttgagtctgttattatttacacagatgttattatgctatagcttctatttctgtttttgcttcttatttctcttataattctcacttatttcctattttttctactcatttctatttgttactcctttttactggacatgatgtttacaagatacaactgtgttactgtattccatctagtacggggcctttggtgtggcttactatttcattgtgtgcacccacccacccaccacactggacttttctagagatggacagcttggttacctccaccttcctgcactcattctcaaacatactgatgttcatacaaaccagcagagtgctgagggacgatatgtactattacaaaaccagacacttttacattcatggtccaacagaacacatggcctagaggcaatgttgcatataccttaatctttgatatgaataatatctttgttctttatatttcttaaaacagaaagggtggaaaatcactatacagaagcaatatccaaagatctcctgatcataaagacaaggggtcttttcagtcttccctctcctcaaaccttgtgtagcattgcacaatatagatctcagtcaacattcactgagtgccaagaatgtgagaaacactgtaccatgcctgtcatgcgaaatatttaaataaacagattgtcttacag

SEQ ID NO: 32 - DNA, 2657 bp, Homo sapiens
tgggaacacaaacttgctggcgggaagagcccggaaagaaacctgtggatctcccttcgagatcatccaaagagaagaaaggtgacctcacattcgtgccccttagcagcactctgcagaaatgcctcctcagctgcaaaacggcctgaacctctcggccaaagttgtccagggaagcctggacagcctgccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactgctggttggctctcactgaccccagggatgtggccaggatcgaaagcaagacggttatcgtcacccaagagcaaagagacacagtgcccatccccaaaacaggcctcagccagctcggtcgctggatgtcagaggaggattttgagaaagcgttcaatgccaggttcccagggtgcatgaaaggtcgcaccatgtacgtcatcccattcagcatggggccgctgggctcacctctgtcgaagatcggcatcgagctgacggattcgccctacgtggtggccagcatgcggatcatgacgcggatgggcacgcccgtcctggaagcactgggcgatggggagtttgtcaaatgcctccattctgtggggtgccctctgcctttacaaaagcctttggtcaacaactggccctgcaacccggagctgacgctcatcgcccacctgcctgaccgcagagagatcatctcctttggcagtgggtacggcgggaactcgctgctcgggaagaagtgctttgctctcaggatggccagccggctggcagaggaggaagggtggctggcagagcacatgctgattctgggtataaccaaccctgagggtgagaagaagtacctggcggccgcatttcccagcgcctgcgggaagaccaacctggccatgatgaaccccagcctccccgggtggaaggttgagtgcgtcggggatgacattgcctggatgaagtttgacgcacaaggtcatttaagggccatcaacccagaaaatggctttttcggtgtcgctcctgggacttcagtgaagaccaaccccaatgccatcaagaccatccagaagaacacaatctttaccaatgtggccgagaccagcgacgggggcgtttactgggaaggcattgatgagccgctagcttcaggcgtcaccatcacgtcctggaagaataaggagtggagctcagaggatggggaaccttgtgcccaccccaactcgaggttctgcacccctgccagccagtgccccatcattgatgctgcctgggagtctccggaaggtgttcccattgaaggcattatctttggaggccgtagacctgctggtgtccctctagtctatgaagctctcagctggcaacatggagtctttgtgggggcggccatgagatcagaggccacagcggctgcagaacataaaggcaaaatcatcatgcatgacccctttgccatgcggcccttctttggctacaacttcggcaaatacctggcccactggcttagcatggcccagcacccagcagccaaactgcccaagatcttccatgtcaactggttccggaaggacaaggaaggcaaattcctctggccaggctttggagagaactccagggtgctggagtggatgttcaaccggatcgatggaaaagccagcaccaacgtcacgcccataggctacatccccaaggaggatgccctgaacctgaaaggcctggggcacatcaacatgatggagcttttcagcatctccaaggaattctgggacaaggaggtggaagacatcgagaagtatctggtggatcaagtcaatgccgacctcccctgtgaaatcgagagagagatccttgccttgaagcaaagaataagccagatgtaatcagggcctgagaataagccagatgtaatcagggcctgagtgctttacctttaaaatcattaaattaaaatccataaggtgcagtaggagcaagagagggcaagtgttcccaaattgacgccacctaataatcatcaccacaccgggagcagatctgaaggcacactttgatttttttaaggataagaaccacagaacactgggtagtagctaatgaaattgagaagggaaatcttagcatgcctccaaaaattcacatccaatgcatactttgttcaaatttaaggttactcaggcattgatcttttcagtgttttttcacttagctatgtggattagctagaatgcacaccaaaaagatacttgagctgtatatatatatgtgtgtgtgtgtgtgtgtgtgtgtgtgtgtgcatgtatgtgcacatgtgtctgtgtgatatttggtatgtgtatttgtatgtactgttattcaaaatatatttaatacctttggaaaatcttgggcaagatgacctactagttttccttgaaaaaaagttgctttgttattaatattgtgcttaaattatttttatacaccattgttccttacctttacataattgcaatatttcccccttactacttcttggaaaaaaattagaaaatgaagtttatagaaaag

SEQ ID NO: 33 - DNA, 468 bp, Homo sapiens
  modified_base (6)..(6): a, c, g, or t
  modified_base (9)..(10): a, c, g, or t
  modified_base (12)..(12): a, c, g, or t
  modified_base (15)..(15): a, c, g, or t
  modified_base (18)..(18): a, c, g, or t
  modified_base (30)..(30): a, c, g, or t
  modified_base (33)..(33): a, c, g, or t
  modified_base (36)..(36): a, c, g, or t
  modified_base (39)..(39): a, c, g, or t
  modified_base (42)..(42): a, c, g, or t
  modified_base (45)..(45): a, c, g, or t
  modified_base (51)..(51): a, c, g, or t
  modified_base (57)..(57): a, c, g, or t
  modified_base (60)..(60): a, c, g, or t
  modified_base (71)..(72): a, c, g, or t
  modified_base (75)..(75): a, c, g, or t
  modified_base (78)..(78): a, c, g, or t
  modified_base (93)..(93): a, c, g, or t
  modified_base (99)..(99): a, c, g, or t
  modified_base (129)..(129): a, c, g, or t
  modified_base (132)..(132): a, c, g, or t
  modified_base (135)..(135): a, c, g, or t
  modified_base (138)..(138): a, c, g, or t
  modified_base (148)..(150): a, c, g, or t
  modified_base (153)..(153): a, c, g, or t
  modified_base (156)..(156): a, c, g, or t
  modified_base (159)..(159): a, c, g, or t
  modified_base (291)..(291): a, c, g, or t
  modified_base (294)..(294): a, c, g, or t
  modified_base (318)..(318): a, c, g, or t
  modified_base (321)..(321): a, c, g, or t
  modified_base (331)..(331): a, c, g, or t
  modified_base (333)..(333): a, c, g, or t
  modified_base (339)..(339): a, c, g, or t
  modified_base (384)..(384): a, c, g, or t
  modified_base (387)..(387): a, c, g, or t
  modified_base (405)..(405): a, c, g, or t
  modified_base (414)..(414): a, c, g, or t
  modified_base (448)..(448): a, c, g, or t
  modified_base (451)..(451): a, c, g, or t
  modified_base (454)..(454): a, c, g, or t
  modified_base (458)..(458): a, c, g, or t
atggtncanntnacnccngtggagaagtcngcngtnacngcnctntggggnaaggtnaangtggatgaagnnggnggngaggccctgggcagnctgctngtggtctacccttggacccagaggttcttngantcnttnggggatctgnnnacnccngangcagttatgggcaaccctaaggtgaaggctcatggcaagaaagtgctcggtgcctttagtgatggcctggctcacctggacaacctcaagggcacctttgccacactgagtgagctgcactgtgacaagctncangtggatcctgagaacttcaggctnctnggcaacgtgntngtctgngtgctggcccatcactttggcaaagaattcaccccaccagtgcangcngcctatcagaaagtggtngctggtgtngctaatgccctggcccacaagtatcactaagctngcnttnttgntgtccaattt

SEQ ID NO: 34 - DNA, 2148 bp, Homo sapiens
gactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaaaaaaaaaaaa

SEQ ID NO: 35 - DNA, 488 bp, Homo sapiens
cagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgccccttgggc

SEQ ID NO: 36 - DNA, 2566 bp, Homo sapiens
cgctttttttttttttttctttttttgagatggagcttgctctgtcacccaggctggagtgcagtggcacgatcacagctcactgcaacttccgccacctgggttcaagcaattttcctgcttcaacctcccgagtagttgagattacaggcacgtgccaccacacctgactgatttttgtatttttagtagagacagggtttcaccatgttggccaggctggtcttgaactcctgacctcaagtgatccacccacctcagtctaccaaagtgctgggattacaggttgtgagccactgcacccggcctctgtctgacttttaaatgatggagtatcccagaggtcaggctttagagctcttctttcttccatctacagagtgctcatttctttggtgatctcattcagtctcacggctttgaatgttatatgctgataagtcccaactttctctgtctcgcctaaacttcccctaatagcagaacctgatatcaaagtgcctatttgacatctccacttagatatctaataagcatctttaatgtaaaatttccaaaactgagctcctacaattccctcccacacttgttcagttttccccatctaagctaatggcaactccatccctccagttgctttggccaaaacttttgagttgtctttgactgctttttttctcccttcttacattgtgctcatcctttctttcaggcaaattctgtttggtataccttcaaatatatctagaattctatacttctcactacccctcattcccattatctttgaaacacactccaatgaggtttttacccccactattccaccaaaaacactcttgtgaaagtcaccagatgatggttcttcaggctatcatctgtctcctgaattattttaagagcctccctaactggtctccttgttccagcccctgctcccttcactctattctcaatacaacagtcagagggatcttataaaaccgtaagtcagatcatataattctgtgtgaaaccctccaatgttatcccacttcagagtaaaagttaaagggtttattttgatctctaaatattttgatccctatgatctagtctcttcttacccaaagtatgggcctcataccagcagaactggcattctctgggagcttgttagaaatgtagaatctctggtcctaagattttctaaatcagaatctgcattttcatcagctctcttggcaattcatatgtttgagaaggactgatgtagtcctctactgcctctcctgctgctatgtgctgctctagtcacactgtcctcctggctatttcgataagatggaaactctcctgcctcagggcttttgcacctactgctccctctgtctaggataatcttccccagaaaactgcatgccagttgccttatttccttcaggtctttattgaagtcactttctcattaaacactttctggcccatcctgtctaaaactgcatccccaaacccttcctatcccttttctccacttttttctttttttaaactatagttcttatcaacatagtatatgttttgcttatttatcctgtttattgtctgactcaacaagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcctttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 37 - DNA, 2148 bp, Homo sapiens; identical to SEQ ID NO: 34

SEQ ID NO: 38 - DNA, 488 bp, Homo sapiens; identical to SEQ ID NO: 35

SEQ ID NO: 39 - DNA, 2566 bp, Homo sapiens; identical to SEQ ID NO: 36

SEQ ID NO: 40 - DNA, 581 bp, Homo sapiens
acaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtctgtgtgccggcccatcactttggcaaagaattcacccaaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattc

SEQ ID NO: 41 - DNA, 491 bp, Homo sapiens
cccacagactcagagagaacccaccatggtgctgtctcctgacgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgcccctttgg

SEQ ID NO: 42 - DNA, 633 bp, Homo sapiens
actcttctggtccccacagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgccccttgggcctccccccagcccctcctccccttcctgcacccgtacccccgtggtctttgaataaagtctgagtgggcggcaaaaaaaaaaaaaaaaaaaaaaaaaacaaaaaaaaaaaaaaaaaaaaaaaaaaaaaa

SEQ ID NO: 43 - DNA, 782 bp, Homo sapiens
  modified_base (114)..(114): a, c, g, or t
  modified_base (712)..(712): a, c, g, or t
cttctgacctgcaggacagttttcctggagccatttggtatgaggtattaatttagcttaactaaattacaggggactcagaggccgtgctcctgaccgatccagacactattnctggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaangaaaaacatgtcttttcaaaatgagaggctttcattgaagaaaagaaaaaaacaacagttaaaagctaaa

SEQ ID NO: 44 - DNA, 756 bp, Homo sapiens
  modified_base (8)..(9): a, c, g, or t
  modified_base (11)..(11): a, c, g, or t
  modified_base (13)..(17): a, c, g, or t
  modified_base (326)..(326): a, c, g, or t
  modified_base (672)..(672): a, c, g, or t
  modified_base (678)..(678): a, c, g, or t
  modified_base (681)..(681): a, c, g, or t
  modified_base (685)..(685): a, c, g, or t
gcgccttnntntnnnnnttttttttttttttttttttaacttcctgcctatacacacgcagccatcagcccacaaagacatgactaccaacgcgggccccttgcacccatactggcctcagcacctaagactggacaactttgtacctaatgaccgccccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggnttcgttctctactacgaagacctgcttggagaccaagccttcttatctcaactctggaaagagtatgccaagggagacagccgatacatcctgggtgacaacttcacagtgtgcatggaaaccatcacagcttgcctgtggggaccactcagcctgtgggtggtgatcgcctttctccgccagcatcccctccgcttcattctacagcttgtggtctctgtgggccagatctatggggatgtgctctacttcctgacagagcaccgcgacggattccagcacggagagctgggccaccctctctacttctggttttactttgtcttcatgaatgccctgtggctgntgctgnctngagnccttgtgcttgatgctgtgaagcacttactcatgcccaaacacgctgggatgccatggccccataagccaa

SEQ ID NO: 45 - DNA, 459 bp, Homo sapiens
  modified_base (12)..(13): a, c, g, or t
  modified_base (445)..(446): a, c, g, or t
  modified_base (448)..(453): a, c, g, or t
tttttttttttnntttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagagnnannnnnnccagca

SEQ ID NO: 46 - DNA, 153 bp, Homo sapiens
  modified_base (2)..(5): a, c, g, or t
  modified_base (11)..(11): a, c, g, or t
  modified_base (137)..(138): a, c, g, or t
tnnnnggctgngagaagacgacagaaggggacagaggcaagaaaagatgttgatcaagaaagatgagaaccaggggtgagggctgaaggagaatcaaagataaaataccagtttaaaaaaaaaaaaaaaaaaaaaanngtcgtatcgaatcga

SEQ ID NO: 47 - DNA, 366 bp, Homo sapiens
  modified_base (19)..(19): a, c, g, or t
  modified_base (84)..(85): a, c, g, or t
  modified_base (89)..(89): a, c, g, or t
  modified_base (93)..(94): a, c, g, or t
  modified_base (96)..(101): a, c, g, or t
  modified_base (172)..(172): a, c, g, or t
  modified_base (191)..(191): a, c, g, or t
  modified_base (267)..(267): a, c, g, or t
  modified_base (278)..(278): a, c, g, or t
  modified_base (282)..(282): a, c, g, or t
  modified_base (285)..(285): a, c, g, or t
  modified_base (301)..(301): a, c, g, or t
  modified_base (328)..(328): a, c, g, or t
ttttttttttttttgccgnccactcagactttattcaaagaccaggaagggccggtgcaaggaggggaggagggcccgttgganngccnagcnngnnnnnngaacggctaccgaggctccagcttaacggtatttggaggtcagcacggtgctcacagaagccaggaacttntccagggaggcgtgcaccncaggggttgaactcggcggggaggtgggcggccagggtcaccagcaggcagtggcttaggagcttgaagttgaccngggtccacccnaagnttntgcgcgtgcaggtcgntcagggcggacagcgcgtttgggcatntcgtccacgtgcgccacggctttgggtcaagcgcgttc

SEQ ID NO: 48 - DNA, 556 bp, Homo sapiens
ttagtgatacttgtgggccagggcattagccacaccagccaccactttctgataggcagcctgcactggtggggtgaattctttgccaaagtgatgggccagcacacagaccagcacgttgcccaggagcctgaagttctcaggatccacgtgcagcttgtcacagtgcagctcactcagtgtggcaaaggtgcccttgaggttgtccaggtgagccaggccatcactaaaggcaccgagcactttcttgccatgagccttcaccttagggttgcccataacagcatcaggagtggacagatccccaaaggactcaaagaaccgagcactttcttgccatgagccttcaccttagggttgcccataacagcatcaggagtggacagatccccaaaggactcaaagaacctctgggtccaagggtagaccaccagcagcctgcccagggcctcaccaccaacttcatccacgttcaccttgccccacagggcagtaacggcagacttctcctcaggagtcaggtgcaccatggtgtctgtttgaggttgctagtgaa

SEQ ID NO: 49 - DNA, 534 bp, Homo sapiens
actcttctggtccccacagactcagagagaacccaccatggtgctgtctcctgccgacaagaccaacgtcaaggccgcctggggtaaggtcggcgcgcacgctggcgagtatggtgcggaggccctggagaggcacttcgacctgagccacggctctgcccaagttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctaagccactgcctgctggtgaccctggccgcccacctccccgccgagttcacccctgcggtgcacgcttccctggacaagttcctggcttctgtgagcaccgtgctgacctccaaataccgttaagctggagcctcggtagccgttcctcctgcccgctgggcctcccaacgggccctcctcccctccttgcaccggcccttcctggtctttgaataaagtctgagtgggcggca

SEQ ID NO: 50 - DNA, 713 bp, Homo sapiens
gaattcggcacgagccggagcgggcgtcatggcgcggctcctctggttgctccggggcctgaccctcggaactgcgcctcggcgggcggtgcggggccaagcgggcggcggcgggcccggcaccgggccgggactgggggaggcagggtctcttgcaacgtgtgagctgcctcttgccaagagtgagtggcaaaagaaactaaccccggagcagttctacgtcacaagagaaaagggaacggaaccgcctttcagtgggatctacctgaataacaaggaagcaggaatgtatcattgcgtgtgctgcgacagtccactcttcagttctgagaaaaagtactgctctggcactgggtggccttcgttttccgaggctcatggtacgtctggctctgatgaaagccacacagggatcctgagacgtctggatacctcgttaggatcagctcgcacagaggttgtctgcaagcagtgtgaagctcatctaggtcacgtgtttcctgatggacctgggcccaatggtcagaggttttgcatcaacagtgtggctttgaagttcaaaccaaggaaacactgaccatcttcaagagtcccgttcccttgccaccccttccacgtgcaccctcaatttcgcacaattcacttgaatgacttgttttatttgcaataaaactgggctgaatttgcaaaaaaaaaaaaaaaaaaaaaaaaaa

SEQ ID NO: 51 - DNA, 3405 bp, Homo sapiens
cgcccaacccaagttcaaaggctgataagagagaaaatctcatgaggaggttttagtctagggaaagtcattcagtggatgtgatcttggctcacaggggacgatgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacggttgaacacaattctaaatacaatgagcaccatctacagtactggaaaagtttgtaacccagataatccacaagaatgcttattacttgaaccaggtttgaatgaaataatggcaaacagtttagactacaatgagaggctctgggcttgggaaagctggagatctgaggtcggcaagcagctgaggccattatatgaagagtatgtggtcttgaaaaatgagatggcaagagcaaatcattatgaggactatggggattattggagaggagactatgaagtaaatggggtagatggctatgactacagccgcggccagttgattgaagatgtggaacatacctttgaagagattaaaccattatatgaacatcttcatgcctatgtgagggcaaagttgatgaatgcctatccttcctatatcagtccaattggatgcctccctgctcatttgcttggtgatatgtggggtagattttggacaaatctgtactctttgacagttccctttggacagaaaccaaacatagatgttactgatgcaatggtggaccaggcctgggatgcacagagaatattcaaggaggccgagaagttctttgtatctgttggtcttcctaatatgactcaaggattctgggaaaattccatgctaacggacccaggaaatgttcagaaagcagtctgccatcccacagcttgggacctggggaagggcgacttcaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatgaaacagaaataaacttcctgctcaaacaagcactcacgattgttgggactctgccatttacttacatgttagagaagtggaggtggatggtctttaaaggggaaattcccaaagaccagtggatgaaaaagtggtgggagatgaagcgagagatagttggggtggtggaacctgtgccccatgatgaaacatactgtgaccccgcatctctgttccatgtttctaatgattactcattcattcgatattacacaaggaccctttaccaattccagtttcaagaagcactttgtcaagcagctaaacatgaaggccctctgcacaaatgtgacatctcaaactctacagaagctggacagaaactgttcaatatgctgaggcttggaaaatcagaaccctggaccctagcattggaaaatgttgtaggagcaaagaacatgaatgtaaggccactgctcaactactttgagcccttatttacctggctgaaagaccagaacaagaattcttttgtgggatggagtaccgactggagtccatatgcagaccaaagcatcaaagtgaggataagcctaaaatcagctcttggagataaagcatatgaatggaacgacaatgaaatgtacctgttccgatcatctgttgcatatgctatgaggcagtactttttaaaagtaaaaaatcagatgattctttttggggaggaggatgtgcgagtggctaatttgaaaccaagaatctcctttaatttctttgtcactgcacctaaaaatgtgtctgatatcattcctagaactgaagttgaaaaggccatcaggatgtcccggagccgtatcaatgatgctttccgtctgaatgacaacagcctagagtttctggggatacagccaacacttggacctcctaaccagccccctgtttccatatggctgattgtttttggagttgtgatgggagtgatagtggttggcattgtcatcctgatcttcactgggatcagagatcggaagaagaaaaataaagcaagaagtggagaaaatccttatgcctccatcgatattagcaaaggagaaaataatccaggattccaaaacactgatgatgttcagacctccttttagaaaaatctatgtttttcctcttgaggtgattttgttgtatgtaaatgttaatttcatggtatagaaaatataagatgataaagatatcattaaatgtcaaaactatgactctgttcagaaaaaaaattgtccaaagacaacatggccaaggagagagcatcttcattgacattgctttcagtatttatttctgtctctggatttgacttctgttctgtttcttaataaggattttgtattagagtatattagggaaagtgtgtatttggtctcacaggctgttcagggataatctaaatgtaaatgtctgttgaatttctgaagttgaaaacaaggatatatcattggagcaagtgttggatcttgtatggaatatggatggatcacttgtaaggacagtgcctgggaactggtgtagctgcaaggattgagaatggcatgcattagctcactttcatttaatccattgtcaaggatgacatgctttcttcacagtaactcagttcaagtactatggtgatttgcctacagtgatgtttggaatcgatcatgctttcttcaaggtgacaggtctaaagagagaagaatccagggaacaggtagaggacattgctttttcacttccaaggtgcttgatcaacatctccctgacaacacaaaactagagccaggggcctccgtgaactcccagagcatgcctgatagaaactcatttctactgttctctaactgtggagtgaatggaaattccaactgtatgttcaccctctgaagtgggtacccagtctcttaaatcttttgtatttgctcacagtgtttgagcagtgctgagcacaaagcagacactcaataaatgctagatttacacactcaaaaaaaaaaaa

SEQ ID NO: 52 - DNA, 1244 bp, Homo sapiens
atggaagccccagctcagcttctcttcctcctgctactctggctcccagataccaccggagaaattgtgttgacacagtctccagccaccctgtctttgtctccaggggaaagagccaccctctcctgcagggccagtcagagtgttggcagctacttagcctggtaccaacagaaacctggccaggctcccaggcccctcatctatgatgcatccaacagggccactggcatcccagccaggttcagtggcagtgggtctgggacagacttcactctcaccatcagcagcctagagcctgaagattttgcagtttattactgtcaacaccgtgacaattggcctccgggggccactttcggcggagggaccaaggtggagatcaaacataccaccggagaaattgtgttgacacagtctccagccaccctgtctttgtctccaggggaaagagccaccctctcctgcagggccagtcagagtgttggcagctacttagcctggtaccaacagaaacctggccaggctcccaggcccctcatctatgatgcatccaacagggccactggcatcccagccaggttcagtggcagtgggtctgggacagacttcactctcaccatcagcagcctagagcctgaagattttgcagtttattactgtcaacaccgtgacaattggcctccgggggccactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagagggagaagtgcccccacctgctcctcagttccagcctgaccccctcccatcctttggcctctgaccctttttccacaggggacctacccctattgcggtcctccagctcatctttcacctcacccccctcctcctccttggctttaattatgctaatgttggaggagaatgaataaataaagtgaatctttgc

SEQ ID NO: 53 - DNA, 465 bp, Homo sapiens
  modified_base (5)..(5): a, c, g, or t
  modified_base (202)..(202): a, c, g, or t
ttttntatactaaccaggggtttaatataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgnggcagaggggggaaggtatgatcgggtgggggtgggacaaggaacggccatggaagatcactgggtcaggttggaccctgggctgggagcgggagggcaaggcccctcaccacaacttaacccaaacctaagctgcccccaggtgccataggtccctgtcccagcagggaggctgatgggcctgggcccatgcccctccccacctttgggggtcagaaaagtggccacccaggcctgctgggatggggcctgacacaggctct

SEQ ID NO: 54 - DNA, 1013 bp, Homo sapiens
atcattcctagaactgaagttgaaaaggccatcaggatgtcccggagccgtatcaatgatgctttccgtctgaatgacaacagcctagagtttctggggatacagccaacacttggacctcctaaccagccccctgtttccatatggctgattgtttttggagttgtgatgggagtgatagtggttggcattgtcatcctgatcttcactgggatcagagatcggaagaagaaaaataaagcaagaagtggagaaaatccttatgcctccatcgatattagcaaaggagaaaataatccaggattccaaaacactgatgatgttcagacctccttttagaaaaatctatgtttttcctcttgaggtgattttgttgtatgtaaatgttaatttcatggtatagaaaatataagatgataaagatatcattaaatgtcaaaactatgactctgttcagaaaaaaaattgtccaaagacaacatggccaaggagagagcatcttcattgacattgctttcagtatttatttctgtctctggatttgacttctgttctgtttcttaataaggattttgtattagagtatattagggaaagtgtgtatttggtctcacaggctgttcagggataatctaaatgtaaatgtctgttgaatttctgaagttgaaaacaaggatatatcattggagcaagtgttggatcttgtatggaatatggatggatcacttgtagaggacattgctttttcacttccaaggtgcttgatcaacatctccctgacaacacaaaactagagccaggggcctccgtgaactcccagagcatgcctgatagaaactcatttctactgttctctaactgtggagtgaatggaaattccaactgtatgttcaccctctgaagtgggtacccagtctcttaaatcttttgtatttgctcacagtgtttgagcagtgctgagcacaaagcagacactcaataaatgctagatttacacaaaaaaaaaaaaaaaa

SEQ ID NO: 55 - DNA, 2254 bp, Homo sapiens
  modified_base (268)..(269): a, c, g, or t
  modified_base (382)..(382): a, c, g, or t
  modified_base (873)..(873): a, c, g, or t
  modified_base (890)..(891): a, c, g, or t
  modified_base (1376)..(1376): a, c, g, or t
  modified_base (1383)..(1383): a, c, g, or t
  modified_base (1385)..(1386): a, c, g, or t
  modified_base (1388)..(1389): a, c, g, or t
  modified_base (1504)..(1504): a, c, g, or t
  modified_base (1766)..(1766): a, c, g, or t
  modified_base (1789)..(1789): a, c, g, or t
  modified_base (1794)..(1794): a, c, g, or t
  modified_base (1796)..(1796): a, c, g, or t
  modified_base (1798)..(1798): a, c, g, or t
  modified_base (1995)..(1995): a, c, g, or t
tttttttttataaaattaataaaaatattttattgaatttcaggaacttggtacttttttaaaacttcaaatctttgcacacaaatcaccactatactttctagaatagtggaagttaggacttcaagattgtcacttatctccttgtgtcacacagcacagaaaccccaagtcctcacactgcccccaccccccttctggccatgactaccaactactctgttattctagcggaggacaatgacggaagtgggtagacgactgaagnngatcagctgtccaccgcgtactctactaaagtgagaggaggagcaaccgaggatcatgccgcacacactctgagtgcaccacgtgacgtgggtcatacgggagttcccttttngttttctcgtttggttcagggcaaagctactgaaattgttcctagtccctgaggagctcagaagttgggcaaaggtcacagcagacttcctgaaaagcagacactgaggaacacagtggagagcgggagttcacagcgacgcagctgaggacgacgcaggacctctcccaaaggtgctgcagctccagcaccaggggccagggctgcggcgacagcagctcagcaacccttgctgtgctcaagttcttggggattcagagctaagttcaaaatttagaaacagtgccttaaagacgggcaagaaaacccggtgtgggagtctgctcatctatggtttgttactgctctcgcttcgatattcttaaattcctaggtaccaatgaaaaagccaagtgaacgtggcagagtgaggaggagacaggagcgtgtgcaccttccatctgtgagaggcacacttcagtctgggttcaagatgcagaatggtgcctacngcaaaaaaaaaaaaaannaccctcctcccttctttaccatttgaatggacattttccttacctgtgatcccaacagaaacagatccagacctatcatgtgaagtccacgttccaggatcagaagtaaccagtttatggactgagcttacacgggaaagtctacccccgactccttctggatagtaacatacacagctgcataaaaacgtctccaaggggacatacgatgcatttgcttggtgtcccagccaagctccccaccggcgacctcactgttccttagagctcgagagctcgtctcctatcaatcagagaaccccatcagctgtgaccaacagagctggagccctctgtggagggagctgaccccacacacaggacagagcagaatcctgattattttacaaactgcaaaccttctgagtaagaagacaaaaatatacattccaaggtatctgtaaagtgcttggaagatgcagacagctgcaccgaggggctctganccatccnanncnnctgcgctttgctgcggtcacacacacggtctcagtcacgtgatggttttgcttttatttcttaaacggctgagtgataatccagctagtgtgcagtcatttcatacctttcaatnggcgtcaccgcagtgacgctgccccagccccatgctgagggccgacacaattcacggaacagattcatcatatttggtctttatgtaaataataaatgttttaaaattgcctaaatataccattctgagccatttcatccctatttcatcccaccaggaaaatacaggttttttcctctctaaaaaaaaattaaataccaaaataactacatttaaataaataatgttatgatgatgacatttaaaagctcagccatcaggntgacgccctctccccatgtgcancggcncncngccctcggccggcacactcgggaagggccagcggttttcttcctgaggagccgggcgaggaggtgcagggacctcccactctcattccctcacccccgtcctgtcctcattttccgtagaggagtcagcctcaggattgggttcggttctgaaaggtcagggacatttcctaccacaaaacaggaaatgccccagangtgccctgcaggacgtggctcggaccctgctccaccatggcggccgctcaccgaaggtggggagtagacagcgggtcagaggcccggcctagagccggagggacaccccatatacaaacataccacggagagacctgggatctgagtttcaaaagggcctgtgataaaagactgaatcgttttccaaatgaagtagaaatggttctgtcgttttaacatacacaagacttaggagacttgttttactcagagtggaaaa

SEQ ID NO: 56 - DNA, 1973 bp, Homo sapiens
  modified_base (69)..(74): a, c, g, or t
  modified_base (326)..(326): a, c, g, or t
  modified_base (402)..(402): a, c, g, or t
  modified_base (411)..(411): a, c, g, or t
  modified_base (443)..(443): a, c, g, or t
  modified_base (470)..(470): a, c, g, or t
  modified_base (598)..(598): a, c, g, or t
  modified_base (600)..(600): a, c, g, or t
  modified_base (602)..(602): a, c, g, or t
  modified_base (605)..(605): a, c, g, or t
  modified_base (611)..(612): a, c, g, or t
  modified_base (620)..(623): a, c, g, or t
  modified_base (630)..(630): a, c, g, or t
  modified_base (634)..(635): a, c, g, or t
  modified_base (639)..(641): a, c, g, or t
  modified_base (644)..(644): a, c, g, or t
  modified_base (650)..(650): a, c, g, or t
  modified_base (654)..(654): a, c, g, or t
  modified_base (666)..(666): a, c, g, or t
  modified_base (675)..(675): a, c, g, or t
  modified_base (678)..(678): a, c, g, or t
  modified_base (681)..(681): a, c, g, or t
ttttttttttgtttttttttttttttttttttttttttttttttttttttttttttttttttttttttnnnnnntgcaaagattcactttatttattcattctcctccaacattagcataattaaagccaaggaggaggaggggggtgaggtgaaagatgagctggaggaccgcaataggggtaggtcccctgtggaaaaagggtcagaggccaaaggatgggagggggtcaggctggaactgaggagcaggtgggggcacttctccctctaacactctcccctgttgaagctctttgtgacgggcgagctcaggccctgatgggntgacttcgcaggcgtagactttgtgtttctcgtagtctgctttgctcagcgtcagggtgctgctgaggctgtaggntgctgtccnttgctgtcctgctctgtgacactctcctgggnagttacccgattggagggcgttatccnaccttccactgtactttggcctctctgggatagaagttattcagcaggcacacaacagaggcagttccagatttcaactgctcatcagatggcgggaagatgaagacagatggtgcagccacagttcntntnatntccacnntggtcccnnnnccgaaantganngggnnnatnatcatnctgntgacagtaatangttgcaaantcntcnggctgcaggctgctgatggtgaaactgaaatgtgtcccagacccacttccactgaaccttaatgggacccctgtttccaaattggatgcatcgtagatgaggagcttaggggctctcccaggtttttgttgataccaatttaaataattattaatggcctgactcgcctggcaggtgatggtgactctgtgtgctcagaataaatattaaataaaacaaagtttttttaaaaaggagtttgcattcagtggactgtcatgcttttggtaactttttttaattactgggataaaactgcacattaagacatattcctaaaaataccagcaaatgcagaaatatacaaattgtgcttaattagcgtacagagtaatgcaacaagtcaatgcaataaatagctcagaacacctaaaaacataaacatttaaaacaatttaatgtaatcaagacaaaatccaaaatttcaatgtattttttatagttaacaactgttttgccttttcagaggtctatgaaagtgacctttcttggaagtcatgaaattggatattttccctcatgcatagtcacccaaaaaaatctgcctggaatcaagagaaatcatgccagaaactcagttaacttaaaggtaatctgatatgtggccttgtctatttcttctaggctataatttctctggggaaagagtgtgacttttagtgtccttaccagggaaaacggtaagcgttttcttccctctagtgatacagcaagatgagtgaaagtggaagatgtcggaaggtgaataggcaagtaatgcttgcaatacattttgatgttcctacagaggtctaaaaacttttggtacctctgtacttctggctgtaacctctaagcttattccattataaacttcaggccccagcttcattctgaggtgattgcgccattgagatcactggtttgttttcttcaactcactcgaaactttactggtatttgttacttcactggtattcacgccagtttaaacattctcttctacagtcaaggtattgtttttaaaggactgttttgtacaaagatttccctgaggctaagtaacctttacatactaaattcttcaaagaaagaaaagaaaacttttccctaaatatgaactctgatgttctgaagttacggtgattttagatcattttttccgatcattatgacatcagagcaaccttatgcaggcttttctgtaaagactcaaagcatggactttagcaataaataatacttcacattgtacactgcaccatcatttaaaa

SEQ ID NO: 57 - DNA, 1304 bp, Homo sapiens
  modified_base (40)..(42): a, c, g, or t
  modified_base (866)..(866): a, c, g, or t
  modified_base (868)..(868): a, c, g, or t
  modified_base (870)..(872): a, c, g, or t
  modified_base (874)..(875): a, c, g, or t
  modified_base (877)..(878): a, c, g, or t
  modified_base (882)..(884): a, c, g, or t
  modified_base (1164)..(1165): a, c, g, or t
tttttttttttttttttttttttttttttttttttttttnnntaataaatatgagcatttatttggcacccgatggcaatacaaaatcctggcagtgggagtggaaaggttctctctctcaaatacttccatactatgtcgacccaaaggcaggacttggcagcaaggctcacaaaccacccaaacaaatatttattgagcaccttgactactacaggcctagcattttgctagggaccatgggagatgtgaaggaagttatctcacacatgatatgtcttcaaggagctaaaaatgccagtggataaaagcaaaacacatggaaaaacaaagtacaaataataatccgtgtatattgtcaaaaggaacattttatcaaaaggtaggattgtagctaaggttggcttgccttcttccctcttttattcaacaaacatttaatgaaggcccactatgtgccaagcacttggtacatgatggtgaataaaacaaacaaggtttctgccctcatttacagcctggtaggggagacagaaatgaacaagtaaaagtagcatatatataaactgcaataaatgcaatgaggggaaaagacaagatgtggtgacagacacagaagtagactgctcagggactgaagggcccgggaattgtcaagacttgaggaagaaggacaccacctgagtcaagagtggtgggggtggagagctgagaaggcccaggaaaagggcaggaaagagcacaaaattagaagctgagaggagaccactcgggctggagcttagcaagaaatcaccatttaatgaggttcaaggggaaggcaagaaccagttctcataaaccaaggtgaagagtttacattttanangnnngnnannagannncagaagggttctaagcaggggggtgatcagatttatatttaaacaaccaaatcctggccaggtgtggtggctcatgcctgtaagcccagctatttgagaggctgaggcgggaagatggcttgaggccaggagttcgagaccagtctgagaaacatagtgagaactcaccttaaaaaacaaaaaacagcaaacaaccaaaaaaaattaaaaaccaaaactactctgttatgtgagaacagactggaggaagaaagaatggaagtttttttttttttttttnnaaaaaaaggtcttgcccgggcgcagtggctcacgcctgtaatcccaacactttgggaggctgaggtgggtggatcatgaggtcaggagatcaagaccatcccggctaacatggtgaaaccctgtctctactaaaaatac

SEQ ID NO: 58 - DNA, 1017 bp, Homo sapiens
  modified_base (234)..(234): a, c, g, or t
  modified_base (238)..(238): a, c, g, or t
  modified_base (243)..(243): a, c, g, or t
  modified_base (301)..(301): a, c, g, or t
  modified_base (387)..(387): a, c, g, or t
  modified_base (406)..(408): a, c, g, or t
  modified_base (1001)..(1001): a, c, g, or t
cagggatgtacttcttatcacatttctatgaagaaatgggaagatcgggatatgaaaaagaaaatgttctatccccaaataaaagcagagcatggttaatgggacctgaatgcacatttatagcataaaagaatgtcaattctatttcataaaggaaaaatctcaactctttgtgactgagtttcacattaactggaactttatttgcttaaaacctaaacattgtcagtttgnaaanaaatnccactgtgacctgtagactgatcttgttgattaaattctagggttttttttttttttnggattcttggtaaaattttatccaaaaaacaggatacatatatatttagagaaggaaatatgaaatcaagagttttggcagccccntgctttttttttttttttnnnagctccctaaagactgtagcaggataaaaggatcactggctccgagtctctttgagataacaagtgatgaaataaaaaagaaagcccataccctcaaataaggtcaggtaaccccattgcccaccctccctacaaggtaaaaaatgagtacttttagtaacagttcagaattcatctttatctcctacctgcctcatcggtggaagtttaaagtcatgattttttttagacattgatacttgtgtctatagacaaataaactcatattagatgacaattgattttttaaaagtccaggtagagaaaggagcaatcattttgaactaaaatctttctatgttttttgattactattcaacttgctattttttagcaaaaagcgaagtttcaatagtgttcatctcaaatcttattgctttacaaccgtggtacacctttcattaaaaataaaaagatgaagcagtcaatccagtgattaatttgacatggctttcattgggaaaggggagggctggcaaagagaccaatagacaaaaaggtaacttaaacacttacacatacaatggtttgctttaaaaaaaaaaaaaaaaaangagagagagagagaaa

SEQ ID NO: 59 - DNA, 1528 bp, Homo sapiens
  modified_base (1490)..(1495): a, c, g, or t
  modified_base (1497)..(1498): a, c, g, or t
  modified_base (1500)..(1500): a, c, g, or t
tttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcctgagtagctggggctacaggtacccgccaccgcgcccagctaatttttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacaagtgcgagccaccgtgtccggccgattctgaacagttttaataccattgctatttttgtgtttttcctgggcctttttttttttttttttttttttgagacagtctcgctctgttgcccaggctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtatctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttannnnnnannanaaaaaaaaaaaaaaaaaaaaaaaaacaa

SEQ ID NO: 60 - DNA, 713 bp, Homo sapiens
  modified_base (27)..(30): a, c, g, or t
  modified_base (32)..(32): a, c, g, or t
  modified_base (34)..(37): a, c, g, or t
  modified_base (39)..(39): a, c, g, or t
  modified_base (148)..(148): a, c, g, or t
  modified_base (526)..(526): a, c, g, or t
  modified_base (532)..(532): a, c, g, or t
  modified_base (539)..(539): a, c, g, or t
  modified_base (542)..(542): a, c, g, or t
  modified_base (545)..(545): a, c, g, or t
  modified_base (557)..(557): a, c, g, or t
  modified_base (559)..(559): a, c, g, or t
  modified_base (596)..(596): a, c, g, or t
  modified_base (603)..(604): a, c, g, or t
  modified_base (616)..(616): a, c, g, or t
  modified_base (621)..(621): a, c, g, or t
  modified_base (629)..(629): a, c, g, or t
tggcacgaggctggaagaattcgcggnnnntntnnnntntttttttttttttttttctgctaccgtgactaagatggaagcgtttttggggtcgcggtccggactttgggcggggggtccggccccaggacagttttaccgcattccntccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttngtgganacaccanggncantcggaggctatncntgatggagagagcttcctcggttatgtggacatgctnggtgtannctatgaagcccnttcgntggccacnggttatggtgcatacttggtcagcctctgctgcgaaaagttcgggaaaagcagccagtgctaagccagaccgaggccggattag

SEQ ID NO: 61 - DNA, 809 bp, Homo sapiens
  modified_base (54)..(59): a, c, g, or t
  modified_base (468)..(468): a, c, g, or t
  modified_base (526)..(526): a, c, g, or t
  modified_base (537)..(537): a, c, g, or t
  modified_base (688)..(689): a, c, g, or t
  modified_base (691)..(693): a, c, g, or t
  modified_base (724)..(724): a, c, g, or t
  modified_base (730)..(730): a, c, g, or t
  modified_base (734)..(734): a, c, g, or t
  modified_base (741)..(741): a, c, g, or t
  modified_base (767)..(767): a, c, g, or t
  modified_base (770)..(770): a, c, g, or t
  modified_base (775)..(775): a, c, g, or t
  modified_base (780)..(780): a, c, g, or t
gcgttcggacccctgtcggatagtaaatcccaggtaaggtacctgcggtcggcnnnnnngctgcgttcggacccctgtcggatagtaaatcccagtaaggtacctgccgtgggcagatctgagctttcttcttggacaccccatacccacagtcctccaggccacccttaagtacaatgttctcctacctaagaaggcatctggattttctctttccttggaaatagtaaagaactactctttgactgtttttgacctcacagtgaacctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatgtttttggtcgagcagacagtttcactttttctgntgagcagagcaaccttgtgttcaacattcagccagccccaggcatggtctacgattantacgaaaaagntggagaagcatttcttttaacaaactgattcttctgtatcaaacctggaaaaaaatcatgaaccatctgacatcgtgaacagtctgcagtgggctatggtttcttgacaagtcttatttccttatcatcccattaaatgttgtcattttgnnannnaaaaaaaaaaaaaaaaaaaaaaaaaaaaaanaaaaanaaanaaaaaanaaaaaaaaaaaaaaaaaaaaaaacanaanaaaanaaaanaaaaaaaaaaaaaaaacaaaaaaaaaaaa

SEQ ID NO: 62 - DNA, 621 bp, Homo sapiens
  modified_base (439)..(439): a, c, g, or t
  modified_base (562)..(562): a, c, g, or t
gttttttttttttttttttttttttggttaccttctcattcatgtcaagtatgtggttcattcttagaaccaagggaaatactgctccccccatttgctgacgtagtgctctcatgggctcacctgggcccaaggcacagccagggcacagttaggcctggatgtttgcctggtccgtgagatgccgcgggtcctgtttccttactggggatttcagggctgggggttcagggagcatttccttttcctgggagttatgaccgcgaagttgtcatgtgccgtgcccttttctgtttctgtgtatcctattgctggtgactctgtgtgaactggcctttgggaaagatcagagagggcagaggtggcacaggacagtaaaggagatgctgtgctggccttcagcctggacagggtctctgctgactgccaggggcggggngctctgcatagccaggatgacggctttcatgtcccagagacctgttgtgctgtgtattttgatttcctgtgtatgcaaatgtgtgtatttaccattgtgtagggggctgtgtctgatcttggngttcaaaacagaactgtatttttgcctttaaaattaaataatataacgtgaataaatga

SEQ ID NO: 63 - DNA, 829 bp, Homo sapiens
  modified_base (62)..(64): a, c, g, or t
  modified_base (575)..(575): a, c, g, or t
  modified_base (638)..(638): a, c, g, or t
  modified_base (659)..(659): a, c, g, or t
  modified_base (693)..(693): a, c, g, or t
  modified_base (775)..(775): a, c, g, or t
  modified_base (823)..(823): a, c, g, or t
ttttttttttttttttttttttttttttggtgggggagttgaaacctaattttgtggcgtannngctatgcagcttgaaatccaagtagcactaaattttattatttcgtatttgtacaataagcttcccaggagacgtgtcaacatttttggtgaagaacttgaaagacttcttaagaagaaatatgaagggcactggtatcctgaaaagccatacaaaggatcggggtttagatgtatacacataggggagaaagtggacccagtgattgaacaagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgcccnggtccactcagcctttaacctttaccactgccacttttgctgccaccaagttcggctctaccnaaatgaagaatagtggccgtnagcaacaaggttgcacgtacttctcccatcaacntcggcttgaatgtgaatgacctcttgaagcagaaagccatctcttcctcaatgcactctctgtatgggcttggcttgggtanccagcagcagccacagcaacagcagcagccagcccagccgccaccgcnaccacg

SEQ ID NO: 64 - DNA, 878 bp, Homo sapiens
  modified_base (26)..(26): a, c, g, or t
  modified_base (28)..(28): a, c, g, or t
  modified_base (39)..(39): a, c, g, or t
  modified_base (560)..(560): a, c, g, or t
  modified_base (565)..(565): a, c, g, or t
  modified_base (633)..(633): a, c, g, or t
tttcgagcggccgcccgggcaggtantnttttttttttntttttttttttttttgctgctccaacgaccagcatgtgttggagcagatctccatggtaagccaaaagtggacttgtcagcctataactactctgcagctgccactaactctacaggcacagtaactacactttatacaggagcacatgccaaagtgcctgggaggtgccaataaaatcaagaaataagaaaactacaaaaaaagatacggtattaaccttggacataattttttttagggaggcagctttcccacttttataaagggggttgtaaatctcaagaggtcatttgttccccatagcagcatatctcatttttaaattgaagcgaattaaataggattttactactcaacattcattatactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcggnaaatnttgactttagttaacattgggtttagcatttccagtgcagcattatcagtgggcctttaaaaatactncgtaagtacattagctttcactttgttgttaaattatagcagactcattatagagaacaagtttgccttgattttgtttaaaatgacttctgctaagcacccagaagataaaattgacatatttttataatataagcatactttttttgtacattgtgttcattcttgaataaaatgagttctgtgttggcttgtagatactaaaaagaaagtattgattttgattcaataaatgttttctttca

SEQ ID NO: 65 - DNA, 751 bp, Homo sapiens
  modified_base (3)..(6): a, c, g, or t
  modified_base (738)..(738): a, c, g, or t
cannnntaaatatgtttaaagaatattataattatatgacttagattgtaaaacaatatgtacagcagtgtcctattttttagaataaaattataaatatgtgctcacatatgtgtttgtgcatgcatagaaaacagattagaaaggaatatattctaacaccattatctctagctggtagaattatggaaaatttttatttccttctttttgcttctaaattttatataatgagcatatttggctttgtataatcatttttaaaaagttgttttagaagaatagtactgatatatcattcccttttagcagttttctctaggataaaaaataagaggaagtctgagcttaactaattaaaaaaacagatttctttaaaaaatattagcaaatcattagtgttcttactggagaaagggcagtgttcaaagaagaattaaacaaatcattccagttgcaggaaaaattcaatttactgcatgcagactgtttcttgactgaaaagttaattcctttcattcagaatcagtatgcatattcactggctatatttcatctcacatctgcaaacttaatttttcctttcttggtcatcagaagattaggaaataaattttagtccaggcaatagatcctacttggcaagctcaaaataactcaattattaaaaagcagcacacaaagaccagtagtgacttccaaaggattgttaacaatacttaaaaaaaaaaaaaaaanaaaaagaaaaaag

SEQ ID NO: 66 - DNA, 572 bp, Homo sapiens
tttttttttttttgcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgggattttctgtactaaaatgttactttgtatcaaaagttaaacaggctttagtacaacaaataaaggtcaatttctgtaaaaaaaa

SEQ ID NO: 67 - DNA, 793 bp, Homo sapiens
  modified_base (618)..(618): a, c, g, or t
  modified_base (632)..(632): a, c, g, or t
  modified_base (661)..(661): a, c, g, or t
  modified_base (678)..(678): a, c, g, or t
ttttaattttgaagctacctgaggtttagaattccttcagccctagctgcttttattctgctttttatttaaacaaaaagagggggaggatctgaaggaaactagttttctgtacaaaggctttgaggtccatggactatacttgtcccatttatcatcccaggtggtgctttgaccctgccataccctggctattaagataaaaagatttgtggacattaaaattatgaatatgtcagtaataatccagcacacattgaaatattgacacagattaccataatttgtgcaacatcttataaacaatgtcatttccatagtagtctaaggcttcaccagcctggcccactgtatctagactttaggttcattttaataattatgctttccttctctgtatcatttgggaagttgataaatatcacttccttagataccttcattcagtgatatatctggcttttacaattaaattggaaaaggtaagtttctctttggtgggttgagagttggaccatcaattctaatctacaaaaggaaattcatgatttcactctgacgcctaggatctagccaaggctggtctgcagtatcagatgtccaaactcatctactatnagccatattttgtnagtcgtttgtctaaactttgtcaaaaatncctttgccatgattttnttgctatctggatttcaaacatggacagttaggaagatgtgcattgaagtaggaaaattttgttcagatttgctgttatttattttttaaattaaaaatggaaatgtattttaaa

SEQ ID NO: 68 - DNA, 1150 bp, Homo sapiens
ctagtctcgagttttttttttttttttttctgtctctgtgtttgaagtttcagtttctgttttctaggtaaggcttatttttgattagcagtcaatggcaaagaaaaagtaaatcaaagatgacttcttttcaaaatgtattgtttagcacttaactcagatgaatttataaattattaatcttgatactaaggatttgttacttttttgcatattaggttaatttttaccttacatgtgagagtcttaccactaagccattctgtctctgtactgttgggaagttttggaaacccctgccagtgatctggtgatgatctgatgatttatttaaagagccgttgatgcctccaggaaacttaagtattttattaatatatatataggaatttttttttattttgctttgtctttctctcccttcttttatcctcatgttcattcttcaaaccagtgttttggaagtatgcatgcaggcctataaatgaaaaacacaattctttatgtgtatagcatgtgtattaatgtctaactacatacgcaaaaacttcctttacagaggttcggactaacatttcacatgcacatttcaaaacaagatgtgtcatgaaaacagcccctttacctgccaagacaagcagggctatatttcagtgacagctgatatttgttttgaaagtgaatctcataatatatatatgtattacacattattatgactagaagtatgtaagaaatgatcagaacaaaagaaaatttctattttcatgcaaatatttttcatcagtcatcactctcaaatataaattaaaatataacactcctgaatgcctgaggcacgatctggattttaaatgtgtggtattcattgaaaagaagctctccacccacttggtatttcaagaaaatttaaaacgatcccaaggaaagatgatgtgtatgttaaagtgactgcacaagtaaaagttcaatgttgtgtgcatgaaaaggattccttggttatgtgcagggaatcatctcacatgctgtttttcctatttggtttgagaaacaggctgacactattctctttgattagaaaataaactcataaaactcataatgttgatataatcaagatgtaaccactataaatatgtagaagaggaag

SEQ ID NO: 69 - DNA, 734 bp, Homo sapiens
  modified_base (93)..(93): a, c, g, or t
  modified_base (95)..(95): a, c, g, or t
  modified_base (554)..(554): a, c, g, or t
  modified_base (559)..(559): a, c, g, or t
  modified_base (646)..(646): a, c, g, or t
gatgtttaataccttctgaaacaggagggtaagatcagatgggaagcccctctgttgaaggatcttgggaaccttggtggttttttttttttngnttttttttttttgatcgagctgtggacatccttcttaattcgattctgaggatttgtttaactaaaaagttcccaaacacagaaagggcctccccacctgctttggggagctgtctgtgctgggagtgccaggcatcccatgggacccatcactgccagtgtctgtgcctcccagaggtcagccgtgtctgccctggctctgtctcctctgtgacagggcagagcatttctggtcagtttctccatggtgcctcccacccctttgtaaagtggatggacatgatggaattcagttgtctcaccctgatagcctgggtgttgatattcactttacccgcactcagacacaggcgaccttgaagcagttctcggtgtgtagagtccacgtgacagtccccacagcctccccagatagctgtgtgcctgtgcgctactgctgtgccattttcccaacttggncgttncactaaatgcagctgatctctctctctgtgcactcgtgatccatgttgaacaatacatgtaggttctttttccacgcaatgtaagancatgatatactgtacgttggaaagcatttaccttatttatatacctgaatgttcctactacacaaataaacatatattaaattctaaa

SEQ ID NO: 70 - DNA, 483 bp, Homo sapiens
  modified_base (427)..(427): a, c, g, or t
  modified_base (429)..(429): a, c, g, or t
  modified_base (431)..(434): a, c, g, or t
  modified_base (436)..(437): a, c, g, or t
  modified_base (439)..(441): a, c, g, or t
  modified_base (443)..(445): a, c, g, or t
  modified_base (448)..(449): a, c, g, or t
ttttttttttttaaagcctttatcggtatgaaaggttgaatgctctaggtttgagcactgctttctcggcttgctcttctggtgcagtataggcacacctagagggccacgtcagtctttgcgatcaccaaatctggttctgagaaataggcactggcaatttacacatgccttgctgtgtaatctcactatatttgctcaggcaaagtgggagaagcagccttaggttttcattctagagatgccggctttcccacctgatcggcttagagttcacgattgactgttttgggcttcatttcaccctctacataacaagcgggtggactagatgccttagcaagggtccgtgttgtgtggtgtctccagccacgcactcagctcaatcttagcacagttaaaaaatgcctttctagcaagttatctncncnnnncnngnnnannntcnnttcttgtgttcaataaaaagcctcctaatttaat

SEQ ID NO: 71 - DNA, 489 bp, Homo sapiens
cccccccccccctttttttttttttttttacattttaggacactgtgaggggaaaggacaattttgaaattccttttcaaggaaaaaaaaggtctttatgctttgccatgaggccacattcagctgctatttaaacttaatatcttgaacctaaagaatgctgacttttcctacatttccagagttaggcagtattctacacttaaagactactactatttttataaaaggtaatctattcaaatttcttcacagatttcaagtctctcaaacatcaagacaacttcagcagtcggtacaagtcacatttcattttgattgaatacatgatcttgaacagctcctgtacttgctctttgtaaaaaaaaataaaattattttgaattattctacctttgtaaacaattggctaaaagaatcatctttaagaaattaagccatttacatgtttgtgtttttctatagcagagcattatattttgcattata

SEQ ID NO: 72 - DNA, 548 bp, Homo sapiens
  modified_base (1)..(1): a, c, g, or t
  modified_base (146)..(146): a, c, g, or t
ntttttttacaaaaggaaaaaatattttgtttgaaaatctttgctacatgtcattatttttgccactgtaaagcttagcacagatgccagcaatacagaaatggccaacaagaaaacaaaacagtcaaaaataaaaccctgaaggnaaaagcaaaaacaaaacccccagagcatcttctcgctatcctccccttccccaaaagccctataataactgtacaatattatagtcctgatcacatttaaaaagtcgattattaaaaaacaagggttccattggaaactcaactttttggtttcgtaaattgtgatataaatatatatgtatactgtaagtgtgcacatagaataaaaaaataaactgtctccttttttactccactacctggcaccagactggagacataaggaagggaaactcagcaaatggacattcctttggcctcttcaaggccacccttgctcctcagtcccctatgactacatttaatatatcttctcattaattcagtcttgcactttagctactggccaaagccaatttaaaa

SEQ ID NO: 73 - DNA, 871 bp, Homo sapiens
  modified_base (33)..(33): a, c, g, or t
  modified_base (47)..(47): a, c, g, or t
  modified_base (49)..(49): a, c, g, or t
  modified_base (83)..(83): a, c, g, or t
  modified_base (124)..(124): a, c, g, or t
  modified_base (129)..(129): a, c, g, or t
  modified_base (856)..(857): a, c, g, or t
  modified_base (859)..(860): a, c, g, or t
ggcacgaggttttttttaattacatgtaattgnttatttaaaataantntccaagtcttccaatgatttaacaggctttgctncacttttatcatctcaaacagctataaatcaacacactttntgtantttattttactactatgtatgctattttaataacatttttctttattaatactagaaccaaatatattgaccaataagcagtatagatttaaattatcttcttgggttggtctgaggttgctgatggattcttgggattgatctgatgctagaagctatcttaggccctgtctctaactcactgtatgtttcaggcaaaacatgccacggttctaggtctgttttctcatctgcaaaataaacacccaaattagatgatacttattgttttaactagctataaaattccaatactatattccccatcattttcacttacttttacttaatctttatttgctacttttccacctataaagcgtaattttccatatcaagtaaacataaattcattaaaaaataaacacaaacccaaaatattcttattctaatatatctgcattaatagataaaaaggctttagctttaattttcatttttcatttctacctcttaaagtcaatgataaactcacaagtgtaaaatgaatgcatttaaaaacataaaagatacatttcaatgacaagaaatatgcaatgatcatgaaaatctactgtacactttgccacggtcaaagaatgaaggacaatatggaaaagccaatcttcaaatatatccttaacaaaaactctctcctgcatagtaaaagcatcatctaaacagcagctccaaccaaaaaaaaaaaaannanncgggggagagg

SEQ ID NO: 74 - DNA, 545 bp, Homo sapiens
  modified_base (106)..(106): a, c, g, or t
  modified_base (108)..(109): a, c, g, or t
  modified_base (134)..(134): a, c, g, or t
  modified_base (445)..(445): a, c, g, or t
  modified_base (504)..(517): a, c, g, or t
  modified_base (520)..(520): a, c, g, or t
  modified_base (522)..(523): a, c, g, or t
  modified_base (529)..(529): a, c, g, or t
cagtagagatggggcttcatcatgttggccaggtggtcctgaactcctgacctcaagtaatctgcctgccttggccttccaaaatgcttgggattacaggcgtgancnnctgcgcctggtccctattttctttntacaacagaccttgggaaatattttcttcccccaagaggttgaggcccatggaatgcattaggggcaggtggggtggtggtgctctgtagcctttaggacttctagaatcaggcttctgggccaccttcttagcaggtgtatacctctttgttccagactgactttctgtctcacaatatcttcactatttccacagttgcagccaagacaggaaactgaaagctgaggccagaagggtggtgtactggggggaggggaaaattgagtgtcactttggaaaactggggcccccatctaaggattgctgccnctgtagattcaaaagcaataaaacagcagctcattaactcttaaaaaaaaaaaaaaaannnnnnnnnnnnnngtntnnataaanatttttgctttgctgt

SEQ ID NO: 75 - DNA, 590 bp, Homo sapiens
  modified_base (181)..(181): a, c, g, or t
  modified_base (341)..(341): a, c, g, or t
  modified_base (385)..(385): a, c, g, or t
  modified_base (415)..(415): a, c, g, or t
  modified_base (419)..(419): a, c, g, or t
  modified_base (435)..(435): a, c, g, or t
  modified_base (447)..(447): a, c, g, or t
  modified_base (454)..(454): a, c, g, or t
  modified_base (457)..(457): a, c, g, or t
  modified_base (465)..(465): a, c, g, or t
  modified_base (470)..(470): a, c, g, or t
  modified_base (482)..(482): a, c, g, or t
  modified_base (489)..(489): a, c, g, or t
  modified_base (492)..(493): a, c, g, or t
  modified_base (498)..(498): a, c, g, or t
  modified_base (500)..(500): a, c, g, or t
  modified_base (514)..(519): a, c, g, or t
  modified_base (524)..(524): a, c, g, or t
  modified_base (527)..(528): a, c, g, or t
  modified_base (532)..(533): a, c, g, or t
tttttttttggtgacacgatgctgcattctaaaacttttatagttttagactatgtatgatgtgttgttgtaatctccatccaccataggatagagttaaaggcattctttgcaggcatattttgtatgccactgttttttgaaatgtgaaaaaaacgttggcatacttagttattttttnggacaagctacacttcaagcttgtttttaatgttaatttgatagtgtgtgtttttttttttaaacaaatcaagaagctgaaaaatttttaggattgttggtgcttagtagacttgataactattttaaaaatgcgtgaatttagtaaaattctttttttnctcactatgcatgtgtaaatgtttgtaacctggcttccctcttntccagtggtataaagaattgtgccgctttnaggnttgggttttttttttntccagtaaaaantttggtnccntatttgangtttncatttaaaatgngacattnttnngtggnanattcaaatattttnnnnnnctgtnttnntttnngggaaacccctttttatgaaagaaaatttttaggggttgtgctcaaaaatgggtttc

SEQ ID NO: 76 - DNA, 617 bp, Homo sapiens
  modified_base (15)..(15): a, c, g, or t
  modified_base (395)..(395): a, c, g, or t
  modified_base (534)..(534): a, c, g, or t
ttttttttttttttntggttctctgccctttattgcttcacaaattatcacaccaaagatctattatttatgcattacagtacatcagatatgcaggaactgattagatgaaaaactttgtacttttctttattcaaaagcaacaacattaagcattcaaaattatacagttttccctaaactttttaaaggtctactaggacagagaagaaactagtccacaatagctatggatggccattaatactatgatattaataaaaattactcacagtacacagacaacaaattaaatgtctatcagggtaagtttgcttaagtaaatgatgagacaaacataatttaaatctagtcattgacatcagaaaacaactattacatattaaatgggaganaaatggatcctatttatgtaaaattgtaagagaggtgctcagaaagatgttcaccagaaacttaacagtggttatcaatgagtagtgagatctggagtaatgtgttctttcttcctttgtacattgctatattatttgnctttttattaatatacaagtatcattttcacataggtagttttttttttttaataacccacctacagaaagacattcatgttc

SEQ ID NO: 77 - DNA, 1734 bp, Homo sapiens
  modified_base (24)..(25): a, c, g, or t
  modified_base (69)..(69): a, c, g, or t
  modified_base (76)..(76): a, c, g, or t
  modified_base (156)..(156): a, c, g, or t
  modified_base (159)..(159): a, c, g, or t
  modified_base (173)..(173): a, c, g, or t
  modified_base (218)..(218): a, c, g, or t
  modified_base (236)..(236): a, c, g, or t
  modified_base (243)..(243): a, c, g, or t
  modified_base (283)..(283): a, c, g, or t
  modified_base (323)..(324): a, c, g, or t
  modified_base (332)..(332): a, c, g, or t
  modified_base (379)..(379): a, c, g, or t
  modified_base (507)..(507): a, c, g, or t
  modified_base (547)..(547): a, c, g, or t
  modified_base (572)..(572): a, c, g, or t
  modified_base (576)..(576): a, c, g, or t
  modified_base (604)..(607): a, c, g, or t
  modified_base (609)..(609): a, c, g, or t
  modified_base (739)..(745): a, c, g, or t
  modified_base (755)..(755): a, c, g, or t
  modified_base (1449)..(1449): a, c, g, or t
  modified_base (1456)..(1457): a, c, g, or t
  modified_base (1469)..(1469): a, c, g, or t
  modified_base (1526)..(1526): a, c, g, or t
  modified_base (1536)..(1536): a, c, g, or t
  modified_base (1538)..(1538): a, c, g, or t
gccgcacctacaccagccaacccnngatcccgaggtccgacagcgcccggcccagatccccacgcctgnccaggangcaagccgagagccagccggccggcgcactccgactccgagcagtctctgtccttcgacccgagccccgcgccctttccnggnacccctgccccgcngggcagcgctgccaacctgccggccatggagaccccgtcccagcnggcgcgccacccgcagcnggggcgncaggccagctccactccgctgtcgcccacccgcatcaccncggctgcaggagaaggaggacctgcaggagctcaatgatnngcttggcnggtctacatcgaccgtgtgcgctcgctggaaacggagaacgcagggnctgcgccttcgcatcaccgagtctgaagaggtggtcagccgcgaggtgtccggcatcaaggccgcctacgaggccgagctcggggatgcccgcaagacccttgactcagtagccaaggagcgcgcccngcctgcagctggagctgagcaaagtgcgtgaggagtttanaggagctgaaagcgtgcaataccanaganggagggtgacctgatagctgctcaggcnnnngnctgaaggacctggaggctctgctgaactccaaggaggccgcactgagcactgctctcagtgagaagcgcacgctggagggcgagctgcatgatctgcggggccaggtggccaagcttgaggcagccctannnnnnnggccaagaangcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggccgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtggngggcagnngtcaccaaaaangcgcaaactggagtccactgagagccgcagcagcttctcacagcacgcacgcactancgggcgcgtngnccgtggaggaggtggacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaactttaaaaaaaaaaaaaaaaaa

SEQ ID NO: 78 - DNA, 3999 bp, Homo sapiens
  modified_base (2855)..(2856): a, c, g, or t
  modified_base (2861)..(2861): a, c, g, or t
  modified_base (2863)..(2864): a, c, g, or t
  modified_base (2869)..(2869): a, c, g, or t
  modified_base (2872)..(2873): a, c, g, or t
  modified_base (2875)..(2876): a, c, g, or t
  modified_base (2879)..(2879): a, c, g, or t
  modified_base (2881)..(2881): a, c, g, or t
  modified_base (3024)..(3024): a, c, g, or t
  modified_base (3409)..(3409): a, c, g, or t
tttttttttttttttttttttttttgtagaagaaaacgattttttaataaatgcttaacccagttcaacatgaagactgggatttggaatgccttaaaagtctgaaggatgttgagttcaatgaggcagaagaagtggttccactgtaatttgtgattgtcgaggaagaggtgtggctgttggtgtgatagtaatactgctggtgactttattggttgttttgtttagtgccccgttaattaagccttgagttcggttatcctgcagtggtgctgaagggctggcaggtctcacagggctggctacagcttgcatgtaaggacttcctaagtgaatgtggattttattatcctcagtagttatcacacttgagctattgctgtttgaacgctgaaactgccatgatgactgccggtctggggagactctgaatatcgcatgcttggcactgatttctgttggttctggggagcgtccctgctcaggagagctagctgaaccagtcacagccaaaacctgaataggggacattgtcctttctggagttagagaaccacaagactctggggtctgtgctctggcaaaggttgccatggtaattggggacatgccttgttctaaattcatgaggtcttcggtagaggttttggactttactggtgttatggaggcgttttggaggatggttatcctttgctttggcgtgccacagttcggtatcactgcagtactcgtgtaagagtgaggactctctgtggttggacttgtgatttcaagagtggctgtgttttgtacatggtctggagtaacctttatatgaagtggctgcccaggtgtgtggcttaggactagatctccaggttgcacaaagttggcattgggtttagtttgcatttttccattctgaagatggccctccttggatttcatccagggaatccatagctttctgttaacaggacatggagtagactggctgcatttgaaggacagcacagatccctcatcattagggtcctcgtcttgattctcactctcctcatataactgaccattgatgactgcacgttccagaggaatgaggctcttgtaatcaggtggttcattgtctactgcttctgtctgaacttctttagaaaatacttgaggatcggaaattcttcttccattgagactaggcctgaggctcttactgaaatgccggtacctctctaactccttagtgaggttttcaatctctcttcctaaatctctgttcctgttttcttgttgatttagtttttttttgcaggactgagtgatctccctggaggtgacatattaggtcttcagttgccatgtattcatgaattttctcttttaatgcatccacttctcttgagaggtgccctgacttagcttcttcttcttgaagccttttgaaaagccattgttcatggctggtctctgtcttttctgctaacttgtacttagcaagttccattttaacatgttctagctctttagataaaaattgagctttgtctcgttcattagcataccttcgttctagagtctcatattcatcttctgttttcatgaggtcatcctcaatggctttcatgtcctttagcttcagtttcagtctttccacttcttgagagagctccttaatcttattgttttcttggtgtaatgctgttgtggatttcccagagtcttgatttaatttgttttttaggaaatctttctcaattgcttccaatgattgaagcctatttttcaacatattaactcttgacaggagatcatttcctttctcttcttccgctttcaatttgttttttaaatcatctctctccttggttacgctgtacatcttttcttctacatcggttttggacttgagcgcccttttagtttcctcaattaacttctcagtaactgttgttactttattttgctccacttgaagctgagaagaagcagcttgtaatttatcttcagttttctttaatttttcactcattgttttccgttcatctacaaacatcacagttaatgttttcagtttagttaaatcctcttttagagtgaattctgtcttttctagccgactttcaatggcttctagctctttgatccttacttttaaactctccagttcttgagacaactgctttgtggtcatcctttctttttctaaattgcatttcagagagtagcattcttgtttgcttttgttgaaagcgtcttctaacttttccagagccataattcttttactgagtttttcaacctctagtttaaagtctttactctgtaacgtctccctttcaagcctcttattgagatctctgcactgctcctccatttttatgagctcttcatctttcccttccatatctagcacacgtttcctgagctcttccacttcagccatgataccagcgtttccatattctcccttactgattttttcttttatatcttgcagctcctcttctgcttttcgtaaagacctgtttgtctcttctaactcatcaatctgccggctgagtgctgccagcttttgttgaagctggcgattttgactgtcctcattggtgagcttcgccataattgtgtcttggtcttggtgaaactttgtggtctgcgtttgcagttccttctctagtctggttgccttctgctcttcctcctgaactctggcttcagcaagggctagtttggtatgtgtttcctttgcatttgtggtcagctcttggattttctgtctttgaagggtgagctgtgccgtcagcctttgctgttcatccaccaccatcaaagcaaaagacttcagcttggtcagctcctctttcagggtggtgacnnttttntnnttttnttnntnnttntnctcctgagacttgatttcttgatcaattagcttctttaatctttcacattcctgttctagtaggcatatgaattcatcactcttctccatgtattctttatgttttctcttttcttcctccaactccaatatggtttgcctangggatttttctgccactaaaagctgtcccaggattcgtctgtaagattctttatgtttttccacaactttgtccaactcattcattggtttctcatagatgtcctcctgccaaggggtagatttcgcttgaaaagcatctctctggagagcctctaacaccttttttggagtgacaaacccatactgagcttccagcaaagccaggtccattttttcagcctttaaaatgcctatgacctcatctcgagcctgcagttctccctccagaatgctgaggagaaataacaggtcatctcttgagaggtcttctgcttggtggccattaccactgtgtggcttctctgccttgggacacggaagtattacatccgactcactgggggnagtctttgtcttgctgtctatgcttcatgtttttaggcccttggaaactgtggcctttagtatgtcttggaaatttcttttgggctgagccctcggtatcactgcctctggaacgcattctttaaagccgtgcaggtaccgtgcaggtgttgatcacacctggtaattccttcttctcatccccaccaaaatccaacagtggaatccaggaccaacaacaacgttttcttcttctctttttggacaccctctcagtttttgttttgtaggcttgaaagccaccgagagtttgcaaccaggggccagtgatagctctgcaaaggagaggcagtggggagcccaacaacaagtaggcccaaacactaaatattgccctcttccctctccgggcagtgtccttcatgctctgaagacaggcagccttaccaaaactcttaccccacagcttgccagtctctgtggaagaaaggttctaactggactgggctgcaggatgaggtgacccaaaagccaggaaccatctgcgcagagcagacaagtagaggcaggcacaggctccgtgagcacgtctgtgtgtgtgtgtgtgtgtg

SEQ ID NO: 79 - DNA, 774 bp, Homo sapiens
  modified_base (2)..(30): a, c, g, or t
  modified_base (208)..(208): a, c, g, or t
  modified_base (436)..(436): a, c, g, or t
  modified_base (631)..(631): a, c, g, or t
tnnnnnnnnnnnnnnnnnnnnnnnnnnnnntttttttttttttgctgataagaattcttttatgttattccaataaaaaatacattcatacagaaatataacaatcttgcaaaaaacaatttcaaataaaatcttgtaaaacaaaattttacaaaaatcttacaaagattctttagataacagggtgcttccaaaaaaaaaaaaaaangaaatttcactaatagaaatttttttttaatttcaagcaaaaagtttctgcttgattgaggctcagttatcacctgaacagaatgtacttctttatgtacgtgctaattatgaaaatcacaggcattgacaggtacggtacccagccccacccaggcaaacagctccgacatgtttcgtaagtgagacaagccagtgcaagtttttttttttcctttttttttttttngtcttttgcttaccttcttgcttaatggaattgttatggctaagcacatagaaggccaaaaaaggagttttccaaacccagcaaatcaagtgcttggattctgaactgccaaaagaaaactgcacttcccctcttaagtaaaacgaaatgagtttcttaggtaaatgtattcatcagcccagataaaaaaaaaanccagttatgtgagcgttagtcactgctcatttccaggaagatcaaacaaaataccagcccagccagactcacatgtgtgtatatatatataaagcaaagagccacacccacaagccagcagctgggtgaaatatcagctgtcc

SEQ ID NO: 80 - DNA, 338 bp, Homo sapiens
  modified_base (182)..(182): a, c, g, or t
  modified_base (185)..(186): a, c, g, or t
  modified_base (188)..(190): a, c, g, or t
  modified_base (192)..(192): a, c, g, or t
  modified_base (194)..(200): a, c, g, or t
  modified_base (202)..(203): a, c, g, or t
  modified_base (205)..(205): a, c, g, or t
  modified_base (207)..(207): a, c, g, or t
  modified_base (210)..(210): a, c, g, or t
  modified_base (276)..(276): a, c, g, or t
ggtaaggttgaatgcacttttggtttttggtcatgttcggttggtcaaagataaaaactaagtttgagagatgaatgcaaaggaaaaaaatattttccaaagtccatgtgaaattgtctcccattttttggcttttgagggggttcagtttgggttgcttgtctgtttccgggttggggggnaanntnnntngnnnnnnnanncngnttngtgctttgggaagttgtctctgaaacccggggacagaggacgcaggacagactaggagggagccgnggagattgggctgcagctgtggaggagggtttcagaggagagaggtccggagagcagaggcc

SEQ ID NO: 81 - DNA, 514 bp, Homo sapiens
  modified_base (32)..(32): a, c, g, or t
tttttttttttttttttttttttttttttttnttttttttttcttcttcttaatggccccagaagttgacagctttgcccgctcttggatcaccaagctccgatagtgttcgtcacatggatggtcccacatagactgcccgttggcgaagttgaaatagtaaatgtcacctgtgatgtcctggcatggtttccactctccaggcagtggggccacgatgccctctcgcgccagccacatcagttctggttccttgatgggatcaataccaatctcccgggcaaattcaagaatttcttgctcactaggaatgtaggtctcatcataatcttcttccagaaccagctgatctcctatgcggaggggtcgtccagccatgactcatctgggctcaaacacccgccagacccccagcccgggcccggtggcccgctcaggagccggcgagatttcaaacggaggaactgtcgcctggcagtccgattttcacttcttccctcagtcccctcgtgcc

SEQ ID NO: 82 - DNA, 1109 bp, Homo sapiens
ggcacgagggaggtggccccggatgctgcggcgcccgctggccgggctggctgcggccgccctgggccgggccccaccggacggcttgctctgctctttacctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaaaaaaaaaaaaaaaaaa

SEQ ID NO: 83 - DNA, 4153 bp, Homo sapiens
  modified_base (42)..(43): a, c, g, or t
  modified_base (46)..(49): a, c, g, or t
  modified_base (51)..(53): a, c, g, or t
  modified_base (63)..(64): a, c, g, or t
  modified_base (71)..(71): a, c, g, or t
  modified_base (88)..(88): a, c, g, or t
  modified_base (102)..(102): a, c, g, or t
  modified_base (106)..(106): a, c, g, or t
  modified_base (109)..(109): a, c, g, or t
  modified_base (153)..(153): a, c, g, or t
  modified_base (1542)..(1542): a, c, g, or t
  modified_base (3105)..(3105): a, c, g, or t
  modified_base (3121)..(3121): a, c, g, or t
  modified_base (3407)..(3407): a, c, g, or t
ccccggcccggccgggcagctggtaggtgccgtgcgcaaccnnccnnnngnnnccgccccttnnccctttnatgggaatacttttttnaaaaaaaaagagtntcgntgncgccaccccgtaggactggccgccctaaaaccgtgataaagganctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggnaagctatggaggaggacttttagatttagtgaagatggtagggtggaaagacttaatttccttgttgagaacaggaaagtggccagtagccaggcaagtcatagaattgattacccgccgaattcattaatttactgtagtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactatngttttatcctgtcttngggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaantgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattcaaataaaaaaaaaaaaaaaaaaaaaaaaaaaaaaaa

SEQ ID NO: 84 - DNA, 2430 bp, Homo sapiens
gtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttccttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaaaaaaaaaaaaaa

SEQ ID NO: 85 - DNA, 2387 bp, Homo sapiens
gctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagccgagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggacaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 86 - DNA, 3757 bp, Homo sapiens
gcttgccacatgtactatgtggagagatgtaccaccctgcatcagcttttaccctacagaaggaaatcagcgttccattatattttattgttatcaacagtttaggaatacatagctttgcttttgcctttttctttccttccccttgtttcccctcgcctcagagaaaagaaggaaaaaaaaattcatctttcctacccccctctttttggatgataggacttgaagacaatctgaaataccacataaactcacttccagatgttttttgtttcatatgcaattgaattgggctcagactgtgtttttaagctgtatggtaaaaatatcactgtcttctagggccttattggggggcagggagagacgtgacactttgtcagaagggattgagtctgctaacttaaactctccttgattcaggaatacaaagtctccagctgtgaacagagactcatcagtgaaatagagtacaggctagaaaggtctcctatggatgaatcatggtgatgaacgttcacgtacggcagacgctgcctcgtggaaaactggaatggcaccattctttgagatgaagctgaaacattacaagatctttgagggaatgccagtaactttcacatgtagagttgctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactggacggctaatggtacaggctgtcaaccaaagaggtcgaagtccccggtctccctcaggccatcctcatgtcagaaggcctcgttctagatcaagggacagtggagacgaaaatgaaccaattcaggagcgattcttcagacctcacttcttgcaggctcctggagatctgactgttcaagaaggaaaactctgcagaatggactgcaaagtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttggcaaatttttctgaatgtgacctttttttgctgatttgctgggtttgggattaactagcattattttgccacctttatattgtatttataaaaaaaaagtactatcaatcaatcatactactttggattgttgtgctggtgtaatgtggatttaacatcaataaatatttgacaaataaaaaaaaaaaaaaaaaa

SEQ ID NO: 87 - DNA, 3903 bp, Homo sapiens
  modified_base (6)..(6): a, c, g, or t
  modified_base (9)..(9): a, c, g, or t
  modified_base (17)..(21): a, c, g, or t
  modified_base (23)..(25): a, c, g, or t
  modified_base (27)..(27): a, c, g, or t
  modified_base (31)..(31): a, c, g, or t
  modified_base (36)..(37): a, c, g, or t
  modified_base (40)..(47): a, c, g, or t
  modified_base (49)..(52): a, c, g, or t
  modified_base (55)..(55): a, c, g, or t
  modified_base (146)..(146): a, c, g, or t
  modified_base (235)..(235): a, c, g, or t
  modified_base (507)..(507): a, c, g, or t
  modified_base (1978)..(1978): a, c, g, or t
  modified_base (3169)..(3169): a, c, g, or t
  modified_base (3268)..(3268): a, c, g, or t
  modified_base (3275)..(3275): a, c, g, or t
  modified_base (3308)..(3308): a, c, g, or t
tatttnttntttttttnnnnntnnntntttnttttnnttnnnnnnnntnnnnttnttatttgtcaaatatttattgatgttaaatccacattacaccagcacaacaatccaaagtagtatgattgattgatagtactttttttttnataaatacaatataaaggtggcaaaataatgctagttaatcccaaacccagcaaatcagcaaaaaaaggtcacattcagaaaaatttgncaagtaagacataagtcataattctacaatagagataggtccatgagagactgtgtatggtatcttaaattccatattagcaatgcatataagtgcggtcaaagaaacttgaaccacactgcatagaacatctgccacccggtgctcaagcctattaatcacttaaaccttggttggttggtgttcttacaaagaagtagaaagctgtacatgtgaaacagtaatatgaaatatatggggtggtacacagatataaaattattttaaaaaantactacgtatgaattgagtaactgagctaagagaggccacttataaataatgaaagatacatgtgttttgcataaggaatacagtgttttcttttcatagcaaagtaccattaaagcctcatgttttatactactaggtcaaattattttttctcctttttaaaatttatcggttccgacttaaaaccatcaagtctggtcagaatcaactcagtctagctgatgcaaaatcatatgcattcaaaaagcagtctttaccgagatgcctttacaaaccttggaatccagcaccttcttaaggcaaagtttcatggcagcagggaagtgaactaataattttcatttaccacatcttggtgtctttgaaaaaatactttatggcacaaacctgtttttgtctctccttatgtctccacttccttcaagtagactagatgctacaggcaatttctcatttatgccaccatgcagtctcaatccattttcaacttgctctacatacctaaaatcttccactactacacaaacctcagacacactgcaatctccacagcatgtgtgctccacagcatgtgtgctccacacttccagctggccctgggttccttgacttgtgaatggcagtgtttttttcacctatgtttgaagaaaaccaaagaaaagcctggcctttgctacctctcctgtgccttctacttttatctaaatgaacacactataatcatgctggttgcattttccttcattctcctccctactccttccaaacccctgattcctccaaatactatatatgccttggtcatttgggtggtttggatgctttctgtggaatgaactgtaatatatttctgctttattcagagcactttatattatttatatttaaattagccttttaatatggtttgtaaataagtttcctaccaaggtagcatgaaaacactacacataaagaaaaaaaatgttaagaactaaggtattaaccttgttagaaaactcttttgatattaacatttaaggcaagtagttccttccttatgatttaatataaaaacatttgcaaagacaaggcatttacttggatttctttgtcatctcttcttctttcatccttacatattgcacttggttcactgtatctgtctgaatacactgtgcttcagaatcattgtagtactgtttgtggtacaactccctcattaaacatttcacactatcaggctacacagcacctatatcttgtgtttaaaggcacttgtagataatacaaattgtagttacctgtgaacaattgatttcctttagtattttggcattttgatcactttaatcacagcaattccaaagttttaaattggacagtaaatgtgtattttctgtgcaatgtgtatatttgtattagcattatctacttaaactaagtttggtatatcaagtaagaaaaatattattttggtgtttttttttnaatttcttatagtcaaaggtatgtttctgccttttacataatgtgacaaaggaatatgttggtcaaggcaatggctgtttcagtgtttcagctttaacaagaatgctggattacaggtcctcactttctaccaaggcagtattcagtgtcaggtgagatgggttggcctcaggttggaacgctgctttgatgtctagtccctggtccgaaagtgctgcatagcgactggctgagggccgtactttttttggcttggtgctctgtgactgctgatgccactgggtgtaaacgtccagcctggcagtacaggacacaatccctgcttcattcttggctgacacagtataccacccagcatcttcttttgtggctccctgaatgagcaggcagatgtagccgtggttgtcctggtgcatgctcactcggtcagtgctgtgagtgagtgattcattttctttcttccaaaatatctgaggtggtggcactcccaatacacgacattccagccgcactgggtacccatcagcaactcctgtgttttggagcttctcaataaacacagggggtttgtgtgcttctttagcagcaaccacaagctccaggctgaatgagttctgtcctgctcggttggtagctatacatgtgtagatgccggcatcacgtgacgtgactggctctatgatcagagagtgcaccccgttctcacgcaccagcatcttgtgagcactgtcagggcgtacgggctttccatctagttgccagcttagatctggggttggtaacccactgactttgcagtccattctgcagagttttccttcttgaacagtcagatctccaggagcctgcaagaagtgaggtctgaagaatcgctcctgaattggttcattttcgtctccactgtcccttgatctagaacgaggccttctgacatgaggatggcctgagggagaccggggacttcgacctctttggttgacagcctgtaccattagccgtccagtacaactgatgcggccctgagggtttgcagccataattgtataattcccatcatcatctagggtggaggctgtggtatggagggagcaggtcccatcgagatctctttgaatggtgtagtgatcactctttggagagatctgcttcccatctttaaaccaatagatctttggctttggatttccagcnactctacatgtgaaagttactggcattccctcaaagatcttgtaatgtttcagcttcatctcaaagaatggtgccattccagttttccacgaggcagcntctgccntacgtgaacgttcatcaccatgagttcatccanaggagacctttctagcctgtactctatttcactgatgagtctctgttcacagctggagactttgtattcctgaatcaaggagagtttaagttagcagactcaatcccttctgacaaagtgtcacgtctctccctgccccccaataaggccctagaagacagtgatatttttaccatacagcttaaaaacacagtctgagcccaattcaattgcatatgaaacaaaaaacatctggaagtgagtttatgtggtatttcagattgtcttcaagtcctatcatccaaaaagaggggggtaggaaagatgaatttttttttccttcttttctctgaggcgaggggaaacaaggggaaggaaagaaaaaggcaaaagcaaagctatgtattcctaaactgttgataacaataaaatataatggaacgctgatttccttctgtagggtaaaagctgatgcagggtggtacatctctccacatagtacatgtggcaagcagctgccatattatatacaattatagtaaaagaataatagaaaaaatggtactagaaaaaatggtaatagaaaaaatagtaaaagaataataggaaaaaaaaa

SEQ ID NO: 88 - DNA, 655 bp, Homo sapiens
tgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagcggagcttcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaatttttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaag

SEQ ID NO: 89 - DNA, 1330 bp, Homo sapiens
gcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaa

SEQ ID NO: 90 - DNA, 1173 bp, Homo sapiens
aggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggaggtgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggctcagctaagcctctcttcatctggaagaagaggcaagggggcaggagaccaggctctagctctgggccctccttcagcccccatcatgggaataaattaattttctcaatgt

SEQ ID NO: 91 - DNA, 2036 bp, Homo sapiens
ccggccctcgccctgtccgccgccaccgccgccgccgccagagtcgccatgcagatcccgcgcgccgctcttctcccgctgctgctgctgctgctggcggcgcccgcctcggcgcagctgtcccgggccggccgctcggcgcctttggccgccgggtgcccagaccgctgcgagccggcgcgctgcccgccgcagccggagcactgcgagggcggccgggcccgggacgcgtgcggctgctgcgaggtgtgcggcgcgcccgagggcgccgcgtgcggcctgcaggagggcccgtgcggcgaggggctgcagtgcgtggtgcccttcggggtgccagcctcggccacggtgcggcggcgcgcgcaggccggcctctgtgtgtgcgccagcagcgagccggtgtgcggcagcgacgccaacacctacgccaacctgtgccagctgcgcgccgccagccgccgctccgagaggctgcaccggccgccggtcatcgtcctgcagcgcggagcctgcggccaagggcaggaagatcccaacagtttgcgccataaatataactttatcgcggacgtggtggagaagatcgcccctgccgtggttcatatcgaattgtttcgcaagcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacaaa

SEQ ID NO: 92 - DNA, 1887 bp, Homo sapiens
gcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggtaaggagctgggattcgatgcctccgaggtggagttgacgagaaacaatgaattgattgcagttggaaaaggcagctcactgaagcggatccctgtttttggaatggagcctcgcatccgatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacct

SEQ ID NO: 93 - DNA, 5843 bp, Homo sapiens
  modified_base (72)..(75): a, c, g, or t
  modified_base (78)..(89): a, c, g, or t
  modified_base (4902)..(4902): a, c, g, or t
  modified_base (4919)..(4919): a, c, g, or t
  modified_base (4930)..(4930): a, c, g, or t
  modified_base (4946)..(4946): a, c, g, or t
  modified_base (5723)..(5733): a, c, g, or t
  modified_base (5735)..(5737): a, c, g, or t
  modified_base (5740)..(5742): a, c, g, or t
ctaaccgacgcgcgtctgtggagaagcggcttggtcgggggtggtctcgtggggtcctgcctgtttagtcgnnnncannnnnnnnnnnncccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcatngttttcttctctgcttngtctgtgtttngagtctgctttctttngtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaaaaaaaaaaaaaaaaaaaaaaaaaaannnnnnnnnnnannnaannncgcctatagtgaatcctattaccattacctggccgcgttttacacctcttgattggaaaaccctgggttaccaacttaatgccttggaaaaatccactttg

SEQ ID NO: 94 - DNA, 2225 bp, Homo sapiens
cgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtcggtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaaaaaaaaaaaaaaa

SEQ ID NO: 95 - DNA, 2744 bp, Homo sapiens
  modified_base (53)..(54): a, c, g, or t
  modified_base (883)..(883): a, c, g, or t
  modified_base (1020)..(1020): a, c, g, or t
  modified_base (2552)..(2552): a, c, g, or t
  modified_base (2556)..(2556): a, c, g, or t
  modified_base (2558)..(2558): a, c, g, or t
  modified_base (2560)..(2564): a, c, g, or t
  modified_base (2566)..(2571): a, c, g, or t
  modified_base (2574)..(2576): a, c, g, or t
ttttttttttttttttttttttttttttttttttttttttttttttttttttnngcctgaaacaagtcttcatttattgactacagtacagtgatttcgcatcttagctggtaatcaaagatggttatgtattaagtaagagaagacatagtctctcttccaggtatcacctgtcagaaacctgggcaaatttaattttaagaactagaactgcatctcctggtggcagtcgtcaccctgagaacaggaacaaggcaaagaaagcatacaggattttgattctcctacacaggtgcacataaagttagtttattaatgactatattttgaagccagccattttgtccaatatttaaataacaagctgtttaatattaaagcagaaagtactgccacattgtgacagaagtacagctttatccataaacccttcacacaattatacattaaatgctatttttatttaagcaaggcacccctacttgttctaaaatatgggatgtactactccatttaaaaagcaaatgaggagactgatttttttcctatctagagctggtttaaattcaagtgaagccattaattttcttaccagtctggactgttctgacatgtcacttcacagttttgagactaacaaacacccttaggtctaccccaaaccaaaaaaagccagggagggacagtttagacaacttttaagttaagactagaatgcccccttaagtagataggcaccaccgttatacgcctttagcacaaggcttagaaaggcaaaacatttctaaagacataaaaccgccaaattgtcatttacactaagctgtggtattttttgttttgatttttaaaaattcctatctctaagtaatcaaatacagcnaaatttaaaactattctgccaaaccataccagttcaaaggtctgaaaccgttctttgctttggtgaatgtttggttaaaataaatcactgtttcactccatgagaagttttacatcagagcactcaattcacaggcnaaaaaaaaaaagttactttttaaatgaaagcgtttaaagaacactgctgaataaaaatatgtggtctttacaatgagtaacatatcatctatgaaaacaaaccatttaatcatataaaacaaagaccatatttttaaatcagatcctggacagtttaaacaaaaattttaatttgtggtttatttcataatcccaaactggatctttcatttcttcttctaaacagtccactatgaaacttttcttagaagcaattaacccaaaacaccaaaatcatttccctagcagttgctgctaataaactggaactgtatatcccaagtccaagaaagatgtgcaaatgaaatgcttcttgcttcacccttattatctggagcccctagagtcttattttccttttggacatgaattcaggaacagttcaatatacctatgatgaacgtgggaccgatccttgagcatcgctgcaacagcatcctcatgggtctcaaagtgcacatcagcttctccagtggccttcccactggagctgtattccatggtgattctaacaggcttgagtggagcaaaaaagtttataatgtcttgggcattggcttggaaaggtaatcctctcatgtggacaaaatgcagagaagacgtagttccaaaatcagcagcctctggaagcttttctggcacctccttaggcaattctatttccttctcactttcaaaagctgtcatgggttgaatatacctcatttacttcatgttcttcaaagaccatttctggctcagttatatacttagcagtaggaaaagatgcgattttctttcccttataagaaccgacatgtgttcgaacttcattccttctgcttggaaatatctcgatgtatcgattaccaatttcttccctgtgtttcaacagggcttggttggccatttctggttcttcaaattgcacataggcttcccctgtttttcgcctccctctatagtccatcacaaaagtaatgtcaactatattcagtcctgcaaagaagtctacaatgtctttctcattgcaactataaggaagtcctctcaaacgaaccacaccatcatttaccacaggcgaagatttgacctgcaagctcttcattaaggcatccacatcttcattgtttatctcatatacttccacataccgctggcccatgtacatgcggtgcttctctaaggctttctgcacatcctgctctgactccatttcaattaaggcatcaccccttcgtttcccatctctgtttaggagaaaatgtattccattctcaccgttgcggattctgcagtctgaaaaaaagttaagcacatcttccatagtgcatgaccagggcagtccttgagctcgaatgagaaagacatcatccacttcctcttctaacttggacggggccaattcatactcagggggtggtggaaggtcttccaggtaagtagttttggactcctggctgtagctgcgcgtcgggacggcggccgccgccgccagcgactgcggcagcagngagncncnnnnngnnnnnnagnnngcggcggagtagaagggcaggcaggcggcgccggtgcgccggcagctgctgcagttacagccgcagccccggagcagcgccccgagtacccagcgcgtgccggccatggactccggaggcggcgcagggcctgaaggcagctgctccagcagcgatggtgctcgtgcc

SEQ ID NO: 96 - DNA, 1746 bp, Homo sapiens
gagcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagtgt

SEQ ID NO: 97 - DNA, 7560 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgaatccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtttggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcggctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacggcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattggagggaccactgggtgagagaggaataaggcggcccagagcgaggaaaggattttaccaaagcatcaatacaaccagcccaaccatcggtccacacctgggcatttggtgagaatcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgaaaaaaaaccggaattc

SEQ ID NO: 98 - DNA, 1418 bp, Homo sapiens
aactgtgcgaaccagacccggcagccttgctcagttcagcatagcggagcggatccgatcggatcggagcacaccggagcaggctcatcgagaaggcgtctgcgagaccatggagaacggatacacctatgaagattataagaacactgcagaatggcttctgtctcatactaagcaccgacctcaagttgcaataatctgtggttctggattaggaggtctgactgataaattaactcaggcccagatctttgactacagtgaaatccccaactttcctcgaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttctgccttatctaaatcaccagagaccaaacaaggactaatccaatacctcttgga

SEQ ID NO: 99 - DNA, 5515 bp, Homo sapiens
  modified_base (37)..(39): a, c, g, or t
  modified_base (706)..(712): a, c, g, or t
  modified_base (714)..(714): a, c, g, or t
  modified_base (716)..(720): a, c, g, or t
  modified_base (5454)..(5454): a, c, g, or t
ttttttttttttttttttttttttttttttttttttnnnttttaatatgatattttattatgggtgtctgtaaggaaaaaaaagatcaacaaccacatacaagcttacaaagttaaatttcaacacattctctatgctagtgtgacaaaagcagccccataatttggtttttattgttgacctttacaggatgaaggaggagaatcccctgtggcatgccaatgaatctttctgatgggagacatgtacagattttgtgcatttatgttctgaatgcaagtcaacaattctgatctagagtttaaaagtgaaagtacattagcaccataacatgcgtctttaaagccttcccaaatattagtaatcttgaccagcaatgacaagaaaaaagaggagcacctttacaagcagttgatatccaatattaaaataattgtggctttaaaaatatttctttaaattcttgcattacacttttctttttaaaccaatcttccaggagattaatcaatgaaatttataagttttatcaacgtataaaatttttttcatcttctgggactcatagaatacaatctgtgtttctgaccagttgaggtagttaaaatagggagggcttttctaatttcgtatttgactatttcagaaagaaaggttatcttttactggtgagcacagtcattgctctgcagatgggctaggattnnnnnnntntnnnnnttttttgttatcataaagagtgttgaagtttatttattatagcaccattgagacattttgaaattggaattggtaaaaaaataaaacaaaaagcatttgaattgtatttggtggaacagcaaaaaaagagaagtatcatttttctttgtcaaattatactgtttccaaacattttggaaataaataactggaattttgtcggtcacttgcactggttgacaagattagaacaagaggaacacatatggagttaaattttttttgttgggatttcagatagagtttggtttataaaaagcaaacagggccaacgtccacaccaaattcttgatcaggaccaccaatgtcatagggtgcaatatctacaataggtagtctcacagccttgcgtgttcgatattcaaagactgttttgctccattccccagtgtgtttcgtgcaaccatcctccagaactgtgtaggtgaatttgctatttccttcagccttgaattcaccttcatttgaccccatcagcttcagggccttctttacatttccactggcctgatccatgtatgcaatgctatttttgcagtgatatgtgatgttctgggaagctcggctggagagaagtcgaaggaatgccagctgcacatcaaggacatcttcaggaagttcaggattgccgtagctaaactgaaaaccaccatccatggactctccaaaccaaacgtgtttcttctcagcactagaatctgtccaccagtgtttccgtggaacattcaaaggattggcacttatgcatgtttccccagtttccatattacagaataccttgatagcatccaatttgcatccttggttagggtcaacccagtattctccactcttgagttcaggatggcagaatttcaggtctctgcagtttctagcggggtttttacgagaaccatcaggactaatgaggctttctatttgtccattaacagacttgagtgaagtcataatctcatcggtgttgattttgaaatccattggttcatctccataatacggggcaaaaccgccagctttttcacctccaatcccagcaatggcagcggctccaacaccaccacagcaaggaccaggggcaccaggaggtccaggagggcctggttgccctgggtggcctggggagccctcagatcctctttcacctctgttacctcgaggccctggtggtccaatgggacctggatgtccactggttccatctttgccaggaggtccactgggtccaacaggtcctctggggcctgcaggtcctggactgccgattgcaccctgctgaccagcagggcctggagaacctggggcacctggattaccagggaatcctcgatgtcctttgatgccagcagctccacgttcacctgtttcacctttgtcaccacgtgggccttgaggaccaggagcacctcgggaaccagcaggaccgggagcaccagcagggccagcagggccactttctcctctgtcaccactctttccagctggaccgacaggaccaggtgggcctggatgaccaggagcgccaggggcaccaggagagccattttcaccacgatcacccttgccaccaggagatccatctcggcctggaagaccatctgatccagggtttccatctcttccaggttcaccagctgtaccagccagaccaggaagaccctggggtccagggggaccacgttctccactgagaccgttagctcctggtttcccactttcacccttgacaccctgagggccagggcttcccctaggacctggcatgcctggtggtcctgcaagaccccgtgctccagtgatcccagcaatcccaagtgggcctggagctcctggtgggccctgggcaccaggcgatcccttctctcctggttggccagcatcaccttttggtccagacactccagggctgccaggagcaccagtgttacccgcaggacctgggggcccatccttgcctggagaaccgctgggacctgggggtcctgggttaccattactaccaggaggaccaggaagaccacgagcaccagggaagccagcagcaccaggtccaccaggactgccacgttcacctttgacaccttggggaccaggaggaccagcaggtccagaacctccagggggtcctgcaactccaggagggcctccttcacctttctcacccggagcccctctttctcctttaccaccaggttcaccattctgtccaggagcaccagggaaaccagcaggtcctggagggccagtttcacctctctcaccagggctaccacgaggtccagctatacctggaagtccgggggcaccaccttcacccttatctccaggctggccagctgggccaggaggaccaataggaccagtaggaccccttgggccatctttccctgggacaccatcagcacctgggccgcctggttcacccttgtcaccctttggaccaggacttccaagacctcctctttctccaggcattccttgcagaccaggagtaccagcagcaccaggtggcccaggaggaccagcagcaccctttcctccttcgggaccagggggaccagctccacctctaagtcctggggcccctgccaatccaggaggtccacgttcaccaggggcaccagcatcacccttgcctcctggagctccaggtgcaccggcatcaccctttggacctggttccccaggttttccattttctcctggaggaccacctgtaccaggcaagccttgtaatccttgtggaccagggggtcctgtgtctcctttgtcaccaccaggcccagtaggccctgggggtccttgaggtccagtttcaccattctttccaggaggaccctgagggccaggtcctccagggccacctcgttctccattcttaccaggagcaccatcatttcctttaggaccggggaagcccatgacaccaggctgacctcggggaccagatggcccaggaggacctggtcgaccactttctccttgacttccgggaggccctggtttcccatcacttcctggtcctcctggacttccgggcatgcccctcattcctggacctccagggacgccatctctgccaggttctccagcagctcctctgggccctgcagggcctggagcaccacgctctccagcaggacccttttctcctgggatgccatttggtccagcaggtcctcggaacccaggggcacccctttctcctgcagctcctggaagcccatttgcaccaggttctccaggtgatccatccttgccatcttcgcctttagctcctggaacacctggaataccagcctcaccgcgttcaccacgtggtccgggctctcctttggcaccattcttaccaggctcacctgcaccacctcgcagtccaggagcaccattagcaccggctggtcctggaggaccccgggctcccatcagtccaggagctccaggaatgccagcgggacccatttcgcctttaccaccaggactaccattaatcccaggagggccaggaggaccttgagcaccagcgtgtccctgaggtccaggttctcctctttgtccaggggcaccatttgaaccaggagaccctgcaggtccaacttcacccttagcaccaggggatccagggaatccggcagttccaggaggaccaggagggcctggttgaccatcactgcctcgagcaccgtcattaccccgagcacctgcagccccaggaagtcctggccgtcctcgctcaccaggagcccctcttggacccatgggtccaggagctccattttcgcctggaagaccattttcaccctttaatccaggagcacctgtttcacccttttctccatttcgtccatcgaagcctctgtgtcctttcataccagggaatccaggtatcccagctggacctttgatacctggaggtccaggcaatcctcgctctccaggtcgtccgggtctacctgattctccatcttttccagcaggaccagatggacctatagcaccaggaggtcctggagggcctgaaggaccagcttgcccaggttcaccagggggtccttggtatcctggagatccaggggaaccaggatgaccagatgtaccagggggaccgggagggcctggggggccagctggtccaggatagcctgcgagtcctcctactgctactccagacttgacatcatatgaatcatactggggagaatagttctgaggaccagtagggcatgattcacagattccaggggggccaggagaaccaggggaccctggttgtcctggaataccagggtcaccatttctcccaggaataccaggagggcctggatctcccttggggccttgaggtccttgaccattaggagggcgagtaggagcagttggaggctgtgggcaaactgcacaacattctccaaatggaatttctgggttggggcagtctaattcttgatcgtcacatattatgtcatcgcagagaacggatcctgagtcacagacacatatttggcatggttctggcttccagacatctctatccgcataggactgaccaagatgggaacatcctccttcaacagcttcctgttgtgccaaaataatagtgggatgaagcagagcgagaagtagccagctccccttttgcacaaagctcatcatgtctaaatatcagacatgagactctttgtgcaaaaaggagaaaanaaaagcagttcaaagtagcaccatcaagttgttccctgcccttcagcaccgggcccgtcat

SEQ ID NO: 100 - DNA, 1998 bp, Homo sapiens
  modified_base (485)..(507): a, c, g, or t
  modified_base (509)..(510): a, c, g, or t
  modified_base (513)..(513): a, c, g, or t
  modified_base (515)..(515): a, c, g, or t
  modified_base (519)..(519): a, c, g, or t
  modified_base (548)..(548): a, c, g, or t
gaattccattcattacggagttagtttctgctaaatacttactgatgctagagcagacccctggcatctgaggatttaagagttcaactgttctcaatctatgctaaaaaaaaaaaaatgacaaataataaattctacatttccgaggcactaatttgaacttcagaagtgggagggctgatatgtaaggcaagttatttaggaatgaggagggctgacagctgtaactcagtgtggttttgcagctgcctacgttagtaccaggtattccataaaactctgtagaggtcatttacatttcgtaaattctgtaattacaccttactgtatcatgccctagtagtttcacaaacttagatattcacaaaaatgttttggaatatattccttgggaatgtgaagggtctcctatattacattaaacaaaaaaccatgcagttacttagagctcatagagctttctcaaaatcaactactgatcatannnnnnnnnnnnnnnnnnnnnnntnnttntntttntggcaggcaaaatttctttttattgtagngcaattacttaaactggaaatttggctttatgcataataagtcatgtgggtaaaacatccacattgcagttaggtttccagtatctagcttttatttattttttagcaatgacattaacaagattttgccaggttataaaaatgagggctttcttgagaattacttatagtttccgagttgaatggcagagcgcacgtagacacatctgaaggtggatggctgtatctcccagtactggaccgggttgctgaaaagactcacacccgaataagaagcctttttggtgttgtgtccaggtgggcagaagtcacttgatccaactacagagatattgttgttatgaaggtagacaacctggatgtacttatgctctgccagcccaccaggtactctggtaagcttgttgttgtccaagtgaagctccctcagatgaggcgtgttggccagagagccattgtcaacagcagagatgctgttgaaactcaatcccaacttagccaaattattcagtcctttcaggctagctgcatcaactctgctgattttgttgccatcaagatgtaattccgtaagggaaggaggaagaccttgaggaatgctggtgatattggtatcagcaatgcggatgtaggagagcttcttcattccctggaaagccccattttcaattcctgagctcttcagcggattggtgcccagttctatgacaatcatctggttcagtccattgaaagtaacttttcgcactttggtgatctcattctcatgggcacgcagctcctgaagagttttgggcattttttctggcaattccttcagctgattcttggacagataaagtcgttccaacttcaccaaaggtgtaaatgctccaggactaactttgctaattttattgttgacaagaatcaatgcgtgaaggttcttcaggttcttaaagtctccatctttgatttcggttattttgttgttttgcaggtctagcagagttgtgtcagggggaagatcctttggcactttgtccagacccaaatcagaacactggaccactcgaagatggcattgacagcggaaggggcacactgggcctagggagggctcgaagtcgcggtcatcaggaacttctgggcctatcccagaagcctcatcttctagcataaagtcaaataagcctctctgttgaaacggtccagcccaggaaacttgtgcaagcagaaggaggatgatagtggccttcatgatttatctcatgtattttcacaaccagggaaccttttaatccgggaatttgccacaggagccctcacgtaagctgagatgtaattacactaaatattcagcccaagtaaaagagtttgcaggtgtggaaaggaggagggggtaggtgctgctctgtgactaggttgaaaacctcctgcttctactccatagcacagttaaaaaataatc

SEQ ID NO: 101 - DNA, 3304 bp, Homo sapiens
gcgaccgaacgcggcggtcggcagcgttcgcgcgggggcctgcgaagcgctgctcggggccggcactgcccgcggggaggacgcgccgccgccgccacccagcgccgccgccgccgccgcctccagccgggccgccgcgcgtcccgggggccggccccgcgagcgcaggagtaaacaccgccggagtcttggagccgctgcagaagggaataaagagagatgcagggatttgtgaggttacggcgccccagctgcaagatgcactagccggctgaacccgggatcggctgacttgttggaaccggagtgctctgcacggagagtggtggatgagttgaagttgccttcccggggctcattttccacgctgccgagaggaatccgagaggcaaggcaatcacttcgtcttgccattgattgggtatcgggagctttttttttctcccctctctctttcttttcctccgtcttgttgcatgcaagaaaattacagtccgctgctcgcccgccctgggtgcgagatattcagccccgctctctcccgtgcattgtgcaacccaaagatgaaagaccgaaggggagaaagttaaagaaatcgcccacatgcgctggatcagtccacggcttggggaaaggcatccagagaaggtgggagcggagagtttgaagtctttacaggcgggaagatggcggactggagctgaaagtgttgattgggaaacttgggtgattcttgtgtttatttacaatcctcttgacccaggcaggacacatgcaggccaaaaaacgctatttcatcctgctctcagctggctcttgtctcgcccttttgttttatttcggaggcttgcagtttagggcatcgaggagccacagccggagagaagaacacagcggtaggaatggcttgcaccaccccagtccggatcatttctggccccgcttcccggagcctctgcgccccttcgttccttgggatcaattggaaaacgaggattccagcgtgcacatttccccccggcagaagcgagatgccaactccagcatctacaaaggcaagaagtgccgcatggagtcctgcttcgatttcaccctttgcaagaaaaacggcttcaaagtctacgtatacccacagcaaaaaggggagaaaatcgccgaaagttaccaaaacattctagcggccatcgagggctccaggttctacacctcggaccccagccaggcgtgcctctttgtcctgagtctggatactttagacagagaccagttgtcacctcagtatgtgcacaatttgagatccaaagtgcagagtctccacttgtggaacaatggtaggaatcatttaatttttaatttatattccggcacttggcctgactacaccgaggacgtggggtttgacatcggccaggcgatgctggccaaagccagcatcagtactgaaaacttccgacccaactttgatgtttctattcccctcttttctaaggatcatcccaggacaggaggggagagggggtttttgaagttcaacaccatccctcctctcaggaagtacatgctggtattcaaggggaagaggtacctgacagggataggatcagacaccaggaatgccttatatcacgtccataacggggaggacgttgtgctcctcaccacctgcaagcatggcaaagactggcaaaagcacaaggattctcgctgtgacagagacaacaccgagtatgagaagtatgattatcgggaaatgctgcacaatgccactttctgtctggttcctcgtggtcgcaggcttgggtccttcagattcctggaggctttgcaggctgcctgcgtccctgtgatgctcagcaatggatgggagttgccattctctgaagtgattaattggaaccaagctgccgtcataggcgatgagagattgttattacagattccttctacaatcaggtctattcatcaggataaaatcctagcacttagacagcagacacaattcttgtgggaggcttatttttcttcagttgagaagattgtattaactacactagagattattcaggacagaatattcaagcacatatcacgtaacagtttaatatggaacaaacatcctggaggattgttcgtactaccacagtattcatcttatctgggagattttccttactactatgctaatttaggtttaaagcccccctccaaattcactgcagtcatccatgcggtgacccccctggtctctcagtcccagccagtgttgaagcttctcgtggctgcagccaagtcccagtactgtgcccagatcatagttctatggaattgtgacaagcccctaccagccaaacaccgctggcctgccactgctgtgcctgtcgtcgtcattgaaggagagagcaaggttatgagcagccgttttctgccctacgacaacatcatcacagacgccgtgctcagccttgacgaggacacggtgctttcaacaacagaggtggatttcgccttcacagtgtggcagagcttccctgagaggattgtggggtaccccgcgcgcagccacttctgggataactctaaggagcggtggggatacacatcaaagtggacgaacgactactccatggtgttgacaggagctgctatttaccacaaatattatcactacctatactcccattacctgccagccagcctgaagaacatggtggaccaattggccaattgtgaggacattctcatgaacttcctggtgtctgctgtgacaaaattgcctccaatcaaagtgacccagaagaagcagtataaggagacaatgatgggacagacttctcgggcttcccgttgggctgaccctgaccactttgcccagcgacagagctgcatgaatacgtttgccagctggtttggctacatgccgctgatccactctcagatgaggctcgaccccgtcctctttaaagaccaggtctctattttgaggaagaaataccgagacattgagcgactttgaggaatccggctgagtgggggaggggaagcaagaagggatgggggtcaagctgctctctcttcccagtgcagatccactcatcagcagagccagattgtgccaactatccaaaaacttagatgagcagaatgacaaaaaaaaaaaaggccaatgagaactcaactcctggctcctgggactgcaccagactgctccaaactcacctcactggcttctgtgtcccaagactaggttggtacagtttaattatggaacattaaataattatttttgaaaaaaaaaaaaaaaaaa

SEQ ID NO: 102 - DNA, 1811 bp, Homo sapiens
ggtttgtgtagagaggcgtgcagagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgttggactggtcccgagcaagaaagcccgtctggaagaaaaggaagaagaggagggagcgtcatccgaagtcgccgatcgcctgcagccccctccgggccaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagaggactctgtccccggggagccatcgccttcagtgtgcagggacggcaccgaggagtctgagccgggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttggctgggtgtgggcctggaggaaggtcctggggcgtgcactcgcctgggcagtggggaggagagtggcctgagttacttcacccccgcgtgctgctggttaatgtcccgcgtctctgcaccttcgggtgggagcggggactgatctactttcacattctcaagtttttctcatctgcattagaggtccccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagt

SEQ ID NO: 103 - DNA, 952 bp, Homo sapiens
tgaactctggatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtca

SEQ ID NO: 104 - DNA, 3317 bp, Homo sapiens
ccccagcgaggctccgggagcccttgcctgcgggggtccggggactcgagccggcctccgccccccggacgcacagccagcgtggtccccgcgtgcaacgcgagcgccggggagtggctcctgctttgcccctcgtgggggccgagccaagaccagtctgcaaactccatcccgccggctggaagaagtcgcggagccggcaccaaacccgcagcgtcttcccgcgcggatcccgggacttaaaaagccggggccaccccggcccaggacgggatgcgggtcggtccggtgcgctctgccatgagcggcgcctcgcagccccgcggcccggccctgctcttcccagccacccgaggcgtcccggccaaacgcctgctggacgccgacgacgcggcggctgtggcggccaagtgcccgcgcctctccgagtgctccagccccccggactacctcagcccccccggctcgccctgcagcccgcagcccccgcctgccgctccgggggccggcggaggctccgggagcgcgccggggcccagccgcatcgccgactacctgctgctgcccctagccgagcgcgagcatgtgtcccgggcgctgtgcatccacactggacgcgagctgcgctgcaaggtgtttcccattaaacactaccaggacaaaatcaggccttacatccagctgccatcgcacagcaacattactggcattgtggaagtgatccttggggaaaccaaggcctatgtcttctttgagaaggactttggggacatgcactcctatgtgcgaagccggaagaggctgcgggaagaggaagccgcccggctcttcaagcagattgtctccgccgtcgcccactgccaccagtcagccatcgtgctgggggacctgaagcttaggaagttcgtcttctccacggaggagagaacccagcttagactagaaagtctagaagacacacacataatgaagggggaagatgatgctttgtcagacaaacatggctgcccagcctacgtgagccctgagatcctcaacaccactgggacctactccggaaaggctgcggacgtttggagcctgggggtgatgctctacacccttctggttggacgataccccttccatgactcagaccccagtgcccttttctccaaaattcggcgtggacagttctgcattcctgagcacatttcccccaaagccaggtgcctcattcgcagcctcttgagacgggagccctccgagagactcactgcccccgagatcctactgcacccctggtttgagtccgtcttggaacccgggtacatcgactcagaaataggaacttcagaccagattgttccagagtaccaggaggacagtgacattagttccttcttctgctaatccccaaaacctcagaaacctcataattcttaacacctggcatttccatttctaaagatggacaggccctttggcatggtaccaaccagataatgactgcatcaggatgaaagctgctgaactcggcatggcgcctcctcttctctgttgggatgagtgactttattgatttgagcagcatatgctgtgattggctgccctgcaaatttgtttcccttaaggaaccctcaccaactatctctgctggatttgggagttccgcatcttttgtggagggcagagtatggacatcttacacccggtggtcaagtgtgtaataaacttgagcattcgaatgggagaaaaagcaaatcgcacaatgacatattttgagtaataaccgtatttttcacagggtgacaaattgggccaataaatctgccatctttgaactcatctttggtggctagactgctacggcagcttctctgatgggaaagttccttttttggcttaacactcaccctttcttcacactcacatttaccaatgactctgctccgtttttggagcagactgttttaagttgctcaggagcctgatggaaccatgaaccgagactcttctctgtttcctgccaagacctcatctgcactaatgccttctccctgaccttgacacttccccctttagctataaaagcacttaccagccgaacgtggaacagtatcacaaaagattccatctcccaacgatttcagaactctgagctcagagagactccagattttaaaaaataatttgagtgcttggaaactattagctttttaagttccttccaaatatgttagtacctaccctttactttttccccaagaccatctcagggtggagcattctgtctaagagaagaaagataaggaggctcccacccacctctcccaagagcagacattaaacatctttgtgctttgaagagagtgaattttggatagtcttgtgattctcagactaacttccagaattatactttaacccctcccagatatggtccgcctttggcattgtgtgtacatctgcagttttgcatggtgggttgttaatatttcaaatgtgtggtttatgaatacgtctgtataatcggcttctggagtgaaacagcaaaccccaaatcttcaaagttggaaggaactttaaaaatcatccggtccaatctctttcctctttctgccacctcccaaggcagaaatcccctcttcagcttcttttgtaggtgggaatccagcctctgttagatatgtccagagatggaaactcactcccctacaaaagatggagcttaatggagaaattgcaactttcattaaaaaacaaattcagatgaaatatcagtaactgtcttggacagtgctgaaatcaggtggttaaacgggtaaacaaaatatactgtattttgagaaatggcacaaaaacaggcagtcatctttaagggctatgcctaggcaaactactaacatgcattgtgagaatgccgtgtatacctcacgtactgtgtactttgtacatatattttaccttttatacctatgttcgattttgttttgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgta

SEQ ID NO: 105 - DNA, 6741 bp, Homo sapiens
  modified_base (758)..(758): a, c, g, or t
  modified_base (760)..(760): a, c, g, or t
  modified_base (762)..(766): a, c, g, or t
  modified_base (768)..(775): a, c, g, or t
  modified_base (777)..(782): a, c, g, or t
  modified_base (810)..(810): a, c, g, or t
  modified_base (812)..(812): a, c, g, or t
  modified_base (928)..(928): a, c, g, or t
  modified_base (1203)..(1203): a, c, g, or t
  modified_base (1207)..(1207): a, c, g, or t
  modified_base (1420)..(1424): a, c, g, or t
  modified_base (1485)..(1485): a, c, g, or t
  modified_base (1501)..(1501): a, c, g, or t
  modified_base (1542)..(1545): a, c, g, or t
  modified_base (1692)..(1692): a, c, g, or t
  modified_base (1841)..(1841): a, c, g, or t
  modified_base (1892)..(1892): a, c, g, or t
  modified_base (1931)..(1938): a, c, g, or t
  modified_base (1940)..(1948): a, c, g, or t
  modified_base (2009)..(2009): a, c, g, or t
  modified_base (2871)..(2871): a, c, g, or t
  modified_base (2873)..(2873): a, c, g, or t
  modified_base (3020)..(3020): a, c, g, or t
  modified_base (3380)..(3380): a, c, g, or t
aagcttaaaaaggagtaggcgggaggcgggggcacgatggttccccagaccaccccagcccaggggggttgtgttctggggattcaggaggtcgaggcacccagtccgtggtgagcagggccaggtctccttccttcccaagagcacggtgcgagtgccttccccacagctctcccaggtgtctgtctccctcactcccccagggccaggacagcgagcagggagcacgccttcctcctggtccctcccagaccctcgccaggctcagcagacccctctcctgttgcgttgctccttcggcaggaggtcagcgtgggtgagaagggagcagaggccagatgacccttcatgtcagttcaaggagaggcccccaggtcctcctcacgggttccactcccctcaccctcccagtatccatgagcatcccaccgccaccaagtgcagggcatccagggggtggagagtggatgggcttgaaggggagtgggtatgaggtttggacaaccccagatgtgaagagtgtgtgtgtgtgttgtgcacgtggattgcctgtatggtattgcaggggagaagaggatttggaaaaggtgcaaggaaattgcaagaatagaaaatgaaagaggaagtagaaaggtttgcggtataagaagggtgagagaaaggggagtggggttatggagggatctagaagagaatagtggggagggaaagggcaggaatggaaggcaagcccatcaccccaaggccccttccccatntntnnnnntnnnnnnnntnnnnnntttttttttttttttttttttttttttntntttgggtcatttccacatgctttattccagcaatcaaaataattaaaaacatctcaaattattatacacatacaaaataggtacagagtcttttgcttcctcccacccctaggggnaaaaactgctttgtgctttgggaagttgtctctgaaacccggggacagaggacgcaggacagactaggagggagccgggaggatgggctgcagctgtggaggagggtttcagaggagagaggtcggagagcagaggcctgagaagccagaggcaggtggagagagggtggaaagtgagcagcgggctgggctggagccgcacacgctctcctcccatgttaaatagcacctttagaaaaattcacaagtccccatccacaaaaaaaaaaaaaaanaaanaaaaaatatcaaggaataaaaatagactttgaacaaaaaggaacatttgctggcctgggggggcatctcaatttctatagcaccagtgattccctccccaccccacccatcacatagatgtagcacctttggtataaaaatggggagccgcttccaccctgcccccatccccgcccccaggcagttgccccggtgacacatcaagacaagaannnnntagtctttcagcaacacagttacacaaggaacagaacagaacagtctctcccgcccagccntgcggcacaagggatngacacgcgttccccaaatccgatgtttctgctttgtcgtgnnnngcccttcctgactctcctccgaacccagtgaggggctggtggctcccccggcatgaccccctcaaaaacgaaggggagatgttgcaagagccatgggagcgccagatggcaaggcttctttggcagtctgagaaccccaggtccccnagggcctgggggtgctgggcgggcaggagcgggctgagggtgggggccacttgggtgtttgagcattgcctttgattgctgggcagacaatacattgtttcctgtgtcttctggggagacagatttgggaaggagtggaggggaggccnaaggggggtgtggagaaaggagcagaaagggcagcattggggtttcataanccaacgggcagaaagggacttacccccgcatgggtcttnnnnnnnntnnnnnnnnnttccttttttaaaaagttatttatttattctttttttttttttttttttttttggtaaggnttgaatgcacttttggtttttggtcatgttcggttggtcaaagataaaaactaagtttgagagatgaatgcaaaggaaaaaaatattttccaaagtccatgtgaaattgtctcccattttttggcttttgagggggttcagtttgggttgcttgtctgtttccgggttggggggaaagttggttgggtgggagggagccaggttgggatggagggagtttacaggaagcagacagggccaacgtcgaagccgaattcctggtctggggcaccaacgtccaagggggccacatcgatgatgggcaggcgggaggtcttggtggttttgtattcaatcactgtcttgccccaggctccggtgtgactcgtgcagccatcgacagtgacgctgtaggtgaagcggctgttgccctcggcgcggatctcgatctcgttggagccctggaggagcagggccttcttgaggttgccagtctgctggtccatgtaggccacgctgttcttgcagtggtaggtgatgttctgggaggcctcggtggacatcaggcgcaggaaggtcagctggatggccacatcggcagggtcggagccctggccgccatactcgaactggaatccatcggtcatgctctcgccgaaccagacatgcctcttgtccttggggttcttgctgatgtaccagttcttctgggccacactgggctgagtggggtacacgcaggtctcaccagtctccatgttgcagaagactttgatggcatccaggttgcagccttggttggggtcaatccagtactctccactcttccagtcagagtggcacatcttgaggtcacggcaggtgcgggcggggttcttgcggntnccctctgggctccggatgttctcgatctgctggctcaggctcttgagggtggtgtccacctcgaggtcacggtcacgaaccacattggcatcatcagcccggtagtagcggccaccatcgtgagccttctcttgaggtggctggggnaggaagctgaagtcgaaaccagcgctgggaggaccagggggaccaggaggtccaggagggccggggggaccaacaggaccagcatcaccagtgcgaccgcgaggaccagggggcccaatggggccagggagaccgttgagtccatctttgccaggagcaccagcagagccagggggacctcggggaccagcaggaccagaggctccagagggaccttgttcaccaggagagccaggagggccagggggaccctggaggccagagaagccacggtgaccctttatgcctctgtcgccctgttcgcctgtctcacccttgtcaccacgggggccttggggtccggcggggccacgggcgccnacggggccgacgggaccggcgggaccagcaggaccagtctcaccacgatcaccactcttgccagcagggccaacggggccaggggcaccaggagcaccaggagcaccagggggtccagcggggccggtctcaccacggtcacccttggcgccaggagaaccgtctcgtccaggggaaccttcggcagcaggagccccctcacgtccagattcaccagggggtccagccaatccaggggggcccatgggaccggggggaccacgttcaccacttgctccagagggaccttgtttgccaggttcaccagaggggccaggaagaccagggaagcctctctctcctctctgaccaggcaggccgaccacaccacgctgtccagcaataccttgaggcccgggagtaccaggagcaccagcaggaccatcagcaccaggggatcctttctcgccagcagggccagggggaccagggggaccaacttcaccaggacgtccagcagggccagtctcaccacggggacctttgccgccttctttgccagcaggaccaggagggccagggggtccagcatttccagaggggccaggaggaccgactcggccagcagcaccagggaaaccagtagcaccagggggaccagcgctgccgcgagcacctttggctccaggagcaccaacattaccaatggggccagggggtccagcgggtccggcaggcccagggggaccagcatcgcctttggcaccagcatcaccaggttcgcctttagcaccaggttggccgtcagcaccaggggggccagcaaagccagcagggccggggggaccaggctcaccacggtctccgggggcaccacgagctccagtgggaccagcagggccgctgggaccactttcacccttgtcaccaggggcaccagcagggccaggaggaccaatggggccggtcagaccacggacgccatctttgccaggagagccatcagcacctttgggaccagcatcacctctgtcacccttaggccctggaagaccagctgcaccacgttcaccaggcattccctgaaggccaggggcgccctggctaccgggagctccaggggcaccagcatcacccttagcaccatcgttgccgggagcaccgttggcccctcggggtccagcaggaccagggggaccttgcacaccacgctcgccagggaaacctctctcgcctcttgctccagaggggccaggggcgccaaggtctccaggaacaccctgttcaccaggtttgcctgcttcacctggaggaccagcaggaccagggagaccctggaatccgggggagccagcagggccttgttcacctctctcgccagcgggaccagcagggccagggggtccctgagctccagcctctccatctttgccagcaggaccgacagcgccagggggtccgggaacacctcgctctccagccttgccgggctctccagcagcacctttaggtccagggaatcccatcacaccagcctgaccacgggcaccaggtgggcctgggggtccggggcgaccatcttgaccggcgggaccaggggggccagttttgccatcaggaccagggctgccagggcttccagtcagacccttggcaccaggcagaccagcttcaccgggacgaccagcttcaccaggagatcctttggggccagcggggccaggagaaccacgttcaccagcgggacccttgggaccagcaacaccatctgcgccagggaaaccacggctaccaggtccaccacgctcgccagggggtccgggcaggccagtgggtccgggttcacctcgagctcctcgctttccttcctctccagcagggccagggggtccttgaacaccaacagggccaggctctcccttagcaccagtgtctcctttgctgccaggagcaccaggttcaccgctgttacccttgggaccaggagggccgccggggccctggggtccagaggggcctcgggcaccagggaagccaggagcaccagcaataccaggagcaccattggcacctttagcaccaggctgtccatcagcaccagggtttccagcagggccagcagcaccagcagggccaggggggccaggctcaccacgcacaccctggggaccttcagagcctcggggcccttggggaccagcttcacccttagcaccaacagcaccagggaagccaggaggaccagcggggccggtgggaccagggggcccggcagcaccagtagcaccatcatttccacgagcaccagcagggccaggggctccagggcgacctctctcaccaggcaggccacgggggcccatctgaccaggagctccattttcaccagggctgccaggctcacccttaggaccagcaggaccagcatctcccttggcaccatccaaaccactgaaacctctgtgtcccttcattccagggaggccagctgttccgggcaatcctcgagcaccctgaggcccaggaggcccacgctcaccaggacgaccaggttttccagcttccccatcatctccattctttccagggggacctgggggacctcggggacccatgggacctgaagctccaggctcgccaggctcaccagggggaccttggaagccttggggaccaggtgcaccaggggggccagggagaccacgaggaccagagggacccatggggccaggcacggaaattcctccggttgatttctcatcatagccataagacagctggggagcaaagtttcctccgaggccagggggtccgggaggtccggggggtccggggggtccgggaagtccaggctgtccagggatgccatctcggccaggggggcctgcgggtccccttgggcctcgggggccagtgtctcccttgggtccctcgacgccggtggtttcttggtcggtgggtgactctgagccgtcggggcagacgggacagcactcgccctcggggacttcggcgccggggcagttcttggtctcgtcacagatcacgtcatcgcacaacaccttgccgttgtcgcagacgcagatccggcagggctcgggtttccacacgtctcggtcatggtacctgaggccgttctgtacgcaggtgattggtgggatgtcttcgtcttggccctcgacttggccttcctcttggccgtgcgtcaggagggcggtggccgctaagaggagcaggagccggaggtccacaaagctgaacatgtctagaccctagacatgtagactctttgtggctggggagggggttagcgtccgctcatgcgtggcctcacactccgcgtgcctcctgctccgaccccgaggagaaactcccgtctgct

SEQ ID NO: 106 - DNA, 6741 bp, Homo sapiens; identical to SEQ ID NO: 105
  modified_base (758)..(758): a, c, g, or t
  modified_base (760)..(760): a, c, g, or t
  modified_base (762)..(766): a, c, g, or t
  modified_base (768)..(775): a, c, g, or t
  modified_base (777)..(782): a, c, g, or t
  modified_base (810)..(810): a, c, g, or t
  modified_base (812)..(812): a, c, g, or t
  modified_base (928)..(928): a, c, g, or t
  modified_base (1203)..(1203): a, c, g, or t
  modified_base (1207)..(1207): a, c, g, or t
  modified_base (1420)..(1424): a, c, g, or t
  modified_base (1485)..(1485): a, c, g, or t
  modified_base (1501)..(1501): a, c, g, or t
  modified_base (1542)..(1545): a, c, g, or t
  modified_base (1692)..(1692): a, c, g, or t
  modified_base (1841)..(1841): a, c, g, or t
  modified_base (1892)..(1892): a, c, g, or t
  modified_base (1931)..(1938): a, c, g, or t
  modified_base (1940)..(1948): a, c, g, or t
  modified_base (2009)..(2009): a, c, g, or t
  modified_base (2871)..(2871): a, c, g, or t
  modified_base (2873)..(2873): a, c, g, or t
  modified_base (3020)..(3020): a, c, g, or t
  modified_base (3380)..(3380): a, c, g, or t

SEQ ID NO: 107 - DNA, 2464 bp, Homo sapiens
cggaaacttgggggagtgcacagaagaacttcgggagcgcacgcgggaccagggaccaggctgagactcggggcgccagtccgggcaggggcagcgggacgcggccggagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcacgttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccactggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtccaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccttgcacacctggattcagggcccagcactgccaaactggactactccaagttccaggagctggtgctgccccactttgggaaggaagatgctggggatgtacagcagttctacgacctgctctccggttctctggaggtcatccgaaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgcctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttg

SEQ ID NO: 108 - DNA, 5453 bp, Homo sapiens
  modified_base (498)..(498): a, c, g, or t
  modified_base (549)..(549): a, c, g, or t
  modified_base (552)..(564): a, c, g, or t
  modified_base (566)..(567): a, c, g, or t
  modified_base (569)..(569): a, c, g, or t
  modified_base (581)..(581): a, c, g, or t
  modified_base (686)..(686): a, c, g, or t
  modified_base (1411)..(1411): a, c, g, or t
  modified_base (1414)..(1414): a, c, g, or t
  modified_base (1435)..(1435): a, c, g, or t
  modified_base (1915)..(1915): a, c, g, or t
  modified_base (2753)..(2753): a, c, g, or t
  modified_base (2776)..(2776): a, c, g, or t
  modified_base (2797)..(2797): a, c, g, or t
  modified_base (2812)..(2812): a, c, g, or t
  modified_base (2836)..(2836): a, c, g, or t
  modified_base (2948)..(2948): a, c, g, or t
  modified_base (3472)..(3472): a, c, g, or t
  modified_base (3533)..(3533): a, c, g, or t
  modified_base (3535)..(3535): a, c, g, or t
  modified_base (5047)..(5047): a, c, g, or t
  modified_base (5074)..(5074): a, c, g, or t
  modified_base (5093)..(5093): a, c, g, or t
ttttttttttttttttttttttttttttttttttttttcttttggaaaaccaaacatgctttatttcatttttttcacaatttatttaaacatctcacatatacaaaataggtacaatttaatttttctgcttgcccaagaaacaaagcttctgtggaaccatggaagaagatgaaaatgagactggcaaagaacaaatgctgaatctgaagaagaggacaactttgggcaaataatctgcatacttttaattgggaataagatggaaaatatgaatgctaaatcaaattttttaaaaaatacaccacacgatacaactcaatacaggagtatttcttctcaaattcttctagcaccatcaacattcttcaagtatctgaaatactattaattagcacctttgtattatgaacaaaacaaaacaaggacctcagttcatctctgtctaggtcagcacctaacaatgtggatcacactcatgggaaagtgttttgaggntagtttaaacctttggaagtttgggttttaaacttccctctgtggaagatnttnnnnnnnnnnnnntnntncaaatgtttatnggtttttatttttcaatttttattttggttttcttacaaaggttgacattttccataacaggtgtaagagtgttgaaaaaaaaattcaaatttttgggggagcgngggaaggagttaatgaaactgtattgcacaatgctctgatcaatccttctttttctcttttgcccacaatttaagcaagtagatgtgcagaagaaatggaaggattcagctttcagttaaaaaagaagaagaagaaatggcaaagagaaagttttttcaaatttctttcttttttaatttagattgagttcatttatttgaaacagactgggccaatgtccacaaagaattcctggtcagcaccaccgatgtccaaaggtgcaatatcaaggaagggcaggcgtgatggcttatttgttttgtattcaatgattgtctttccccattcatttgtctttttagagcagccatctacaagaacagtgtaagtgaacctgctgttgccctcagcaacaagttcaacatcattagagccctgtagaatgacagcctttttcaggttgccagtctcctcatccatgtatgcaatgctgttcttgcagtggtaggtgatgttctgagaggcatagttggccagcaggcgcatgaaggcaagttgggtagccatttccttggaagtcactccttctacattatattcaaactggctgccagcattgatagtttctcctagccagacgtgtttcttgtccttggagctcctataccagttcttggctgggatgttttcaggttgggcccggatacaggtttcgccagtagagaaatcacagtatactttgatngcntccatagtgcatccttggttngggtcaatccagtagtaaccactgctccactctgggtggctgagtctcaagtcacggcatgtgcgagctgggttctttctagagccttcaggagtaagaagggtctcaatctggttgttgagagacttcagagtagcatcaacttcatagtccttgggtctgagagaaggtgctgagcgaggctggtcagccctgtagaagtctccatcgtaaccaaagtcataaccaccaccgcttacacctggaggtccaggagggccagggggaccaggggggccagcagggccttggtgaccctgagggcctcgaatgccagcaggtccaaccgtaccaggatgtccagtgcgaccatcttttccagcagggccagaaggaccagcagggcccctaggaccagcaggacccacggagccaggagcaccttgatcaccatggtgaccagcgataccaggcagaccttgcaatccattgtgtcccttnaagccaggaagacctctgggccccttttcaccgggctctcccttatcgccacgaatgccttgtgggccactaggacctcttgggccaacagcaccagcaggaccaacaggaccagaaggaccagtttcaccacggtttccatgtttgccagcaggacccacggggccatgaggaccaggtgcacctgcagcaccaacgggaccaatattgccagggtaaccgcgctctcccttgtgtccgggttgaccatcgcgacctgggggaccatcgttcccagggttgccatcacgaccagcttcaccaggagcaccgttgactccaggactacccacagcaccaggaggaccacgggccccaggagggccggcaatgccaagaggaccaggttcacccacagcaccagcaacaccaggtagaccacgttcacctctcgagccagggagacccagaataccaggagcaccaagaagaccctgaggacctggagtgccaggaggtccagcagtaccagcctctccagagggacccttctcaccagcgaagccagggggaccaactgcacctacttctccagttcggccaactggaccttggtcaccacgaggaccacgaagcccttctttcccagcaggaccagggggaccaggagggccagaaataccagagggtcctgggggaccagtccgtccagcagcaccagggaaaccagtcataccaggggggcctccatcaccacgacttccagcaggaccggggggaccatttggaccagctgggccagcagctccaacggggcctgtgggaccaacaacaccgttttcacccttaggccctttgnctcctctttctcctttagcaccnggttgaccagcagcaccagcnggaccagcaaatccnttggggccagcaggaccgacctcnccacgttcaccagggcttccccgaggaccagcaggaccagcaggaccagcagccccagcttcgccccggtcacctgtggctccagcaggaccaggggcacctacagcaccangagcaccacgagcaccatctctgccagggttaccaatttcacctctgagaccaggttcacccttttctcccttgcctccaggtatgccagcagcacccctctctcctgggagtccactaggaccagatggaccagcagtgcccacagcaccaaccacaccaggttcacccttgtttccatcaggccctgggggtccagaaggacctcggcttccaataggaccagtaggaccggcagcaccactctcacctgggggaccgcgttcccctcttggaccagcaggaccagggagaccaaactcaccatggagacccctttctcctggtttgccaacttcaccagcgggacctgaggggccaggcagaccctggaagcctggaggaccagcgggaccctgttcaccttttccaccttgaacaccctgtggtccaggaggtccctgagcaccattgtttccatcaggacctggagcaccccgagcaccagcaagaccagcatgacctttatcaccgtttttgccaggntcaccagtggggcctttgggtccagggaatccaatgttgccaggctctcctcttgctccancngggccaattgggccaggcctgccgtcgatgccagggaggccgacaggaccttcttttccagcggggccgatatttccaggggaaccaggaagacctctgggtcccatgagaccaggctccccagggcgaccagcatctccattaggtcctcggactccagcagggccacttgcaccacgactaccaggagggcccatgacgccagctctgccatcagctccaggaagaccacgagaaccaggactacctctcagcccaggaggtcctggagggccggcagatccagcttccccattagggcctctctttccttcttcaccactgggaccaggaggaccttggggcccagcagagccgggctcacccttgttaccgctctctcctttggagccagctggaccaggctcaccaacaagtcctctggcaccagtagcaccggcagcaccaacagggccaggaataccgcggggtccagggaggccgggagccccagcaacgccgggaaggccagcagcacccttggcaccagtaaggccgtttgctccaggattaccaggaggtccaacggggccggagaggcctggaagacccacttcaccacggggaccggcgggaccagcaggaccagcgttaccaacagctccaatttcacccttggggccaggggcacctgggaagcctggagggccagcagacccaatgggaccagcaggacccacgggacccacacttccatcactgccacgggcaccagctgggccaggggcaccaacacgtcctctctcaccaggaagcccacgggctcctgtttgacctggagttccattttcaccaggggcaccaggttcacccttcacaccaggagcaccgggctgtcccttcaatccatccagaccattgtgtcccctaatgcctttgaagccaggaagtccaggagttccagggaaaccacgagcaccctgtggtccaacaactcctctctcaccaggtcgtccgggttttccagggtgaccatcttcaccagccttgccaggagggccagctggaccacgagcacctgcaggaccagtttgaccaggttcaccaggctcaccagcaggtccttggaaaccttgagggcctggggctccagctgcaccaggtgggcctctaggtcccattaagcccattggtccagggccaagtccaactccttttccatcatactgagcagcaaagttcccaccgagaccaggggggccaggaggaccaggtggaccaggagggcctgtgggaccatcttcaccatctctgcctggggggcctggtggacccctttctccacgtggtcctctatctccggctgggccctttcttacagtttcctcttgtaaagattggcatgttgctaggcataaggttactgcaagcagcaacaaagtccgcgtatccacaaagctgagcatgtctagcacttagacatgcagactccttgtgtcgcagagcccctgggtcaccggcggaggtatcacntggcgggcgcgggcatgcagtcgtggnccagtacctccaacttagnccgaaacctcctgctgccgtggtgctaaaataacaaatcccggatctgccctatttatacggcaaaagtttccctggccctagggtgcctccaaaagggcctccaccaatgggagggctggggctgggggcccgggcagccacagctgggaggagcctgcgggggcgcagaggagggcccgaatgggggaagggacgtggccacggggctggcttcttaaattggttccattctttttgaggacgtggacacttttgaggctttcaaggggaaactctgactcgttgtctgcatacctccgccctccgcatcctcccgccctcccccgccctttccaagtttggaaacactatgggacac

SEQ ID NO: 109 - DNA, 5086 bp, Homo sapiens
  modified_base (27)..(27): a, c, g, or t
  modified_base (46)..(46): a, c, g, or t
agcaccacggcagcaggaggtttcggnctaagttggaggtactggnccacgactgcatgcccgcgcccgccaggtgatacctccgccggtgacccaggggctctgcgacacaaggagtctgcatgtctaagtgctagacatgctcagctttgtggatacgcggactttgttgctgcttgcagtaaccttatgcctagcaacatgccaatctttacaagaggaaactgtaagaaagggcccagccggagatagaggaccacgtggagaaaggggtccaccaggccccccaggcagagatggtgaagatggtcccacaggccctcctggtccacctggtcctcctggcccccctggtctcggtgggaactttgctgctcagtatgatggaaaaggagttggacttggccctggaccaatgggcttaatgggacctagaggcccacctggtgcagctggagccccaggccctcaaggtttccaaggacctgctggtgagcctggtgaacctggtcaaactggtcctgcaggtgctcgtggtccagctggccctcctggcaaggctggtgaagatggtcaccctggaaaacccggacgacctggtgagagaggagttgttggaccacagggtgctcgtggtttccctggaactcctggacttcctggcttcaaaggcattaggggacacaatggtctggatggattgaagggacagcccggtgctcctggtgtgaagggtgaacctggtgcccctggtgaaaatggaactccaggtcaaacaggagcccgtgggcttcctggtgagagaggacgtgttggtgcccctggcccagctggtgcccgtggcagtgatggaagtgtgggtcccgtgggtcctgctggtcccattgggtctgctggccctccaggcttcccaggtgcccctggccccaagggtgaaattggagctgttggtaacgctggtcctgctggtcccgccggtccccgtggtgaagtgggtcttccaggcctctccggccccgttggacctcctggtaatcctggagcaaacggccttactggtgccaagggtgctgctggccttcccggcgttgctggggctcccggcctccctggaccccgcggtattcctggccctgttggtgctgccggtgctactggtgccagaggacttgttggtgagcctggtccagctggctccaaaggagagagcggtaacaagggtgagcccggctctgctgggccccaaggtcctcctggtcccagtggtgaagaaggaaagagaggccctaatggggaagctggatctgccggccctccaggacctcctgggctgagaggtagtcctggttctcgtggtcttcctggagctgatggcagagctggcgtcatgggccctcctggtagtcgtggtgcaagtggccctgctggagtccgaggacctaatggagatgctggtcgccctggggagcctggtctcatgggacccagaggtcttcctggttcccctggaaatatcggccccgctggaaaagaaggtcctgtcggcctccctggcatcgacggcaggcctggcccaattggcccagctggagcaagaggagagcctggcaacattggattccctggacccaaaggccccactggtgatcctggcaaaaacggtgataaaggtcatgctggtcttgctggtgctcggggtgctccaggtcctgatggaaacaatggtgctcagggacctcctggaccacagggtgttcaaggtggaaaaggtgaacagggtcccgctggtcctccaggcttccagggtctgcctggcccctcaggtcccgctggtgaagttggcaaaccaggagaaaggggtctccatggtgagtttggtctccctggtcctgctggtccaagaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagtggactcccaggagagaggggtgctgctggcatacctggaggcaagggagaaaagggtgaacctggtctcagaggtgaaattggtaaccctggcagagatggtgctcgtggtgctcatggtgctgtaggtgcccctggtcctgctggagccacaggtgaccggggcgaagctggggctgctggtcctgctggtcctgctggtcctcggggaagccctggtgaacgtggcgaggtcggtcctgctggccccaacggatttgctggtccggctggtgctgctggtcaaccgggtgctaaaggagaaagaggagccaaagggcctaagggtgaaaacggtgttgttggtcccacaggccccgttggagctgctggcccagctggtccaaatggtccccccggtcctgctggaagtcgtggtgatggaggcccccctggtatgactggtttccctggtgctgctggacggactggtcccccaggaccctctggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctggacctcctggcactccaggtcctcagggtcttcttggtgctcctggtattctgggtctccctggctcgagaggtgaacgtggtctacctggtgttgctggtgctgtgggtgaacctggtcctcttggcattgccggccctcctggggcccgtggtcctcctggtgctgtgggtagtcctggagtcaacggtgctcctggtgaagctggtcgtgatggcaaccctgggaacgatggtcccccaggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggcgataagggagagcccggtgaaaaggggcccagaggtcttcctggcttaaagggacacaatggattgcaaggtctgcctggtatcgctggtcaccatggtgatcaaggtgctcctggctccgtgggtcctgctggtcctaggggccctgctggtccttctggccctgctggaaaagatggtcgcactggacatcctggtacggttggacctgctggcattcgaggccctcagggtcaccaaggccctgctggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccatgaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatat

SEQ ID NO: 110 - DNA, 4322 bp, Homo sapiens
gggaccgacgacacgcccccctctcctcctttgttccgggggtcggcggccgctctcctgccagagctcgggatctcggccccgggaggcgggcgctcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaagcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaaaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgcctgcctttagcctgggggcccccacctccactctctgggttcctaggaatgtccagcctcggagaccttcacaaagccttgggagggtgatgagtgctggtcctgacaagaggccgctggggacactgtccgttttgtttcgtttctgtgatctcccggcacgtttggagctgggaagaccacactggtggcagaatcctaaaattaaaggaggcagcctcctagttgctgaaagttaaggaatgtgtaaaacctccacgtgactgtttggtgcatcttgacctgggaagacgcctcatgggaacgaacttggacaggtgttgggttgacccctcttctgcaggaagtccctgagctgagacgcaaagttggctgggtggtggtcggcaccctggctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgtcggggtgtcttgccctggggggcttggaacctctgaaggtggggagcggaacacctggcatccttccccagcacttgcattacggtccctgctcttccaaggtggggacagtggcccaagcaaggcctcacacgcagccacttcttcaagagctgcctgcacactgtcttggagcatctgccttgtgcctggcactctgccggtgccttgggaaggtcggtaagagtggactttgtcctgggcttcccttcatggcgtctagacacttttgtggtgatggaaagcatgggacctgtcgtctcagcctgttggtttctcctcattgcctcaaaccctggggtaggtggaacggggggtctcgtgcccagatgaaaccatttggaaactcggcagcagagtttgtccaaatgacccttttcaggatgtctcaaagcttgtgccaaaggtcacttttctttcctgccttctgctgtgagccctgagatcctcctcccagctcaagggacaggtcctgggtgagggtgggagatttagacacctgaaactgggcgtggagagaagagccgttgctgtttgttttttgggaagagcttttaaagaatgcatatttttttacctggttggaattgagtaggaactgaggctgtgcttcaggtatggtacaatcaagtgggggattttcatgctgaacccattcaaagccctccccgtccccgcatttccaggccaccctttggctggcgtctgctggagaggatgtctctgtcgcattcccgtgcagctcagctcgcgcaggttttctctctctccctggatgttgagctctcatcagaatatgtgggtggggggtggacgtgcacgggtgcatgattgtgcttaacttggttgtatttttcgatttgacatggaagcctgttgctttgctctagagaatagtttctcgtgtccccttcgcacgcctcattctttgaacctcatctctgatgtttgatacagatgggggcttgatagctgtggtcccctttcccttctgactacgtgaaaatcaatacctaaatacagaagccttggtctaaacaccgagacttttagtttgcgaaggggcttagatagggagagaggtaacatgaatctggacaggggagggagatactatagaaaggagaacactgcatactttgcaaagccagtgacctccttttgaaggggacattggacgggggccgggggcgggggttcggtttgactaccgtcatgaacttttggcgtatactgattcctccaactctccaccccacaaaataacggggaccaatatttttaactttgcctatttgtttttgggtgagtttcccccctccattattctgtcctgagaccacgggcaaagctcttccattttgagagagaagaaaaactgtttggaaccacaccaatgatatttttctttgtaatacttgaaatttatttttttattattttgatagcagatgtgctatttatttatttaatatatgtataaggagtcctaaacaatagaaagctgtagaagctgtagagataggcttcagttgttaattggtttggagcctcctatgtgtgacttatgactctctgtgttctgtgtatttgtctgaattaatgacctgggatataaagctatgctagctttcaaacaggagatgccttcagaaagctttgtatattttgcagttgccagaccaataaaatacctggttgaaatacatggacgaaaaaaaaaaaaaaaaaaaaaaa

SEQ ID NO: 111 - DNA, 1401 bp, Homo sapiens
cgtattgctcggcccggggagtttcgccccctgcccggctccgcggcgcggaggatggcgtggaaacggctgggcgcgctggtgatgttccctctacagatgatctatctggtggtgaaagcagccgtcggactggtgctgcccgccaagctgcgggacctgtcgcgggagaacgtcctcatcaccggcggcgggagaggcatcgggcgtcagctcgcccgcgagttcgcggagcgcggcgccagaaagattgttctctggggccggactgagaaatgcctgaaggagacgacggaggagatccggcagatgggcactgagtgccattacttcatctgtgatgtgggcaaccgggaggaggtgtaccagacggccaaggccgtccgggagaaggtgggtgacatcaccatcctggtgaacaatgccgccgtggtccatgggaagagcctaatggacagtgatgatgatgccctcctcaagtcccaacacatcaacaccctgggccagttctggaccaccaaggccttcctgccgcgtatgctggagctgcagaatggccacatcgtgtgcctcaactccgtgctggcactgtctgccatccccggtgccatcgactactgcacatccaaagcgtcagccttcgccttcatggagagcctgaccctggggctgctggactgtccgggagtcagcgccaccacagtgctgcccttccacaccagcaccgagatgttccagggcatgagagtcaggtttcccaacctctttcccccactgaagccggagacggtggcccggaggacagtggaagctgtgcagctcaaccaggccctcctcctcctcccatggacaatgcatgccctcgttatcttgaaaagcatacttccacaggctgcactcgaggagatccacaaattctcaggaacctacacctgcatgaacactttcaaagggcggacatagagacaggatgaagacatgcttgaggagccacggagtttgggggccacagcacctgggcacacacccgagcacctgtccattggcatgcttctgctgggtgagcaggacagctcctgtccccagcgaagaatccggctgcccctgggccagtcccaggacctttgcacaggactgatgggtgtaactgacccccacagggaggcaggaaaacagccagaagccaccttgacacttttgaacatttccagttctgtagagtttattgtcaattgcttctcaagtctaaccagcctcagcagtgtgcatagaccatttccaggagggtctgtccccagatgctctgcctcccgttccaaaacccactcatcctcagcttgcacaaactggttgaacggcaggaatgaaaaataaagagagatggcttttgtgaaaaaaaaa

SEQ ID NO: 112 - DNA, 884 bp, Homo sapiens
cgaggttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactc

SEQ ID NO: 113 - DNA, 3273 bp, Homo sapiens
  modified_base (23)..(25): a, c, g, or t
  modified_base (28)..(28): a, c, g, or t
  modified_base (36)..(36): a, c, g, or t
  modified_base (38)..(38): a, c, g, or t
  modified_base (40)..(40): a, c, g, or t
  modified_base (1486)..(1486): a, c, g, or t
  modified_base (1546)..(1546): a, c, g, or t
  modified_base (1719)..(1719): a, c, g, or t
  modified_base (1835)..(1835): a, c, g, or t
  modified_base (2081)..(2081): a, c, g, or t
  modified_base (2221)..(2224): a, c, g, or t
  modified_base (2226)..(2241): a, c, g, or t
  modified_base (2300)..(2300): a, c, g, or t
  modified_base (2323)..(2323): a, c, g, or t
  modified_base (2352)..(2352): a, c, g, or t
  modified_base (2442)..(2442): a, c, g, or t
  modified_base (3174)..(3174): a, c, g, or t
  modified_base (3177)..(3177): a, c, g, or t
  modified_base (3179)..(3182): a, c, g, or t
  modified_base (3184)..(3185): a, c, g, or t
  modified_base (3187)..(3187): a, c, g, or t
  modified_base (3189)..(3190): a, c, g, or t
  modified_base (3195)..(3195): a, c, g, or t
  modified_base (3200)..(3200): a, c, g, or t
  modified_base (3202)..(3204): a, c, g, or t
  modified_base (3206)..(3206): a, c, g, or t
  modified_base (3218)..(3218): a, c, g, or t
  modified_base (3221)..(3221): a, c, g, or t
  modified_base (3240)..(3240): a, c, g, or t
  modified_base (3243)..(3243): a, c, g, or t
ggggcacagctgtgtttggctgnnnggncaagagcncngncaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaanagatggtaaaccagatctgtctccaagaccttggcctctccttggaggacctttaggtcnaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcagganggaactacggggcttacaggagcttttgtgtgcctggtagaaactatttctgttccagtcacattgccatcactcttgtactgcctgccaccgcggaggaggctggtgacaggccnaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaangtcagatgcgtgcccagctcttcaccccccaatctcttggtggggaggggtgtacctaaatatttatcatatccttgcccttgagtgcttgttagagagaaagagaactactaaggaaaataatattatttaaactcgcnnnnannnnnnnnnnnnnnnntgtgtcaccgtatctcaggaagtccagccacttgactggcacacacccctccggacatncagcgtgacggagcccacactgncaccttgtggccgcctgagaccctcgcgncccccgcgccccccgcgcccctctttttccccttgatggaaattgaccatacaatttcatcctccttcaggggatcaaaaggacggagtngggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaanaanannnnannanannaaaanaaaanannnanaaaaaaaaaaanaanaaaaaaaaaaaaaaaaaanaanacaaaacaaaaaaaaaaaaaaaaaaaaaaa

SEQ ID NO: 114 - DNA, 2876 bp, Homo sapiens
gaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaatgtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagc

SEQ ID NO: 115 - DNA, 4426 bp, Homo sapiens
tgccttgaccaggacttgggactttgcgaaaggatcgcggggcccggagaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggctaaccggaaacaggtgggtcacctcctgcaagaagtggggcctcgagctgtcagtcatcatggtgctatcctctgaacccctcagctgccactgcaacagtgggcttaagggtgtctgagcaggagaggaaagataagctcttcgtggtgcccacgatgctcaggtttggtaacccgggagtgttcccaggtggccttagaaagcaaagcttgtaactggcaagggatgatgtcagattcagcccaaggttcctcctctcctaccaagcaggaggccaggaacttctttggacttggaaggtgtgcggggactggccgaggcccctgcaccctgcgcatcaggactgcttcatcgtcttggctgagaaagggaaaagacacacaagtcgcgtgggttggagaagccagagccattccacctcccctcccccagcatctctcagagatgtgaagccagatcctcatggcagcgaggccctctgcaagaagctcaaggaagctcagggaaaatggacgtattcagagagtgtttgtagttcatggtttttccctacctgcccggttcctttcctgaggacccggcagaaatgcagaaccatccatggactgtgattctgaggctgctgagactgaacatgttcacattgacagaaaaacaagctgctctttataatatgcaccttttaaaaaattagaatattttactgggaagacgtgtaactctttgggttattactgtctttacttctaaagaagttagcttgaactgaggagtaaaagtgtgtacatatataatatacccttacattatgtatgagggatttttttaaattatattgaaatgctgccctagaagtacaataggaaggctaaataataataacctgttttctggttgttgttggggcatgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgtgttctgttaatgcctctgagtgtcctacctccttggagatgagatagggaaggagcagggatgagactggcaatggtcacagggaaagatgtggccttttgtgatggttttattttctgttaacactgtgtcctgggggggctgggaagtcccctgcatcccatggtaccctggtattgggacagcaaaagccagtaaccatgagtatgaggaaatctctttctgttgctggcttacagtttctctgtgtgctttgtggttgctgtcatatttgctctagaagaaaaaaaaaaaaggaggggaaatgcattttccccagagataaaggctgccattttgggggtctgtacttatggcctgaaaatatttgtgatccataactctacacagcctttactcatactattaggcacactttccccttagagccccctaagtttttcccagacgaatctttataatttcctttccaaagataccaaataaacttcagtgttttcatctaattctcttaaagttgatatcttaatattttgtgttgatcattatttccattcttaatgtgaaaaaaagtaattatttatacttattataaaaagtatttgaaatttgcacatttaattgtccctaatagaaagccacctattctttgttggatttcttcaagtttttctaaataaatgtaacttttcacaagagtcaacattaaaaaataaattattt

SEQ ID NO: 116 - DNA, 1914 bp, Homo sapiens
gcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttagattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggaacagaattctcccagcgttaacacaaaatccatgggcagcatgatggcaggtcctctgttgcaaactcagttccaaagtcacaggaagaaagcagaaagttcaacttccaaagggttaggactctccactcaatgtcttaggtcaggagttgtgtctaggctggaagagccaaagaaatattccattttcctttccttgtggttgaaaccacagtcagtggagagatgtttggaacacagtcagtggagctggtggtaccaggtttagcattattggatgtcaaaagcattttttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattgtggtaaaa

SEQ ID NO: 117 - DNA, 1975 bp, Homo sapiens
  modified_base (63)..(63): a, c, g, or t
  modified_base (104)..(104): a, c, g, or t
  modified_base (107)..(109): a, c, g, or t
  modified_base (112)..(112): a, c, g, or t
  modified_base (140)..(142): a, c, g, or t
  modified_base (1103)..(1103): a, c, g, or t
  modified_base (1268)..(1270): a, c, g, or t
  modified_base (1286)..(1286): a, c, g, or t
  modified_base (1298)..(1298): a, c, g, or t
  modified_base (1301)..(1301): a, c, g, or t
  modified_base (1342)..(1342): a, c, g, or t
  modified_base (1373)..(1373): a, c, g, or t
  modified_base (1378)..(1378): a, c, g, or t
  modified_base (1386)..(1386): a, c, g, or t
  modified_base (1464)..(1464): a, c, g, or t
  modified_base (1483)..(1483): a, c, g, or t
  modified_base (1486)..(1486): a, c, g, or t
  modified_base (1970)..(1971): a, c, g, or t
  modified_base (1974)..(1974): a, c, g, or t
ccgaacaagatcactcaaggtgaaggataatctactaataccagcactttgaatgaaaatttntttctctgccacaaactgaacatcttttttttttttttttnttnnngtnggggagttgaaacctaattttgtggcgnnnagctatgcagcttgaaatccaagtagcactaaattttattatttcgtatttgtacaataagcttcccaggagacgtgtcaacatttttggtgaagaacttgaaagacttcttaagaagaaatatgaagggcactggtatcctgaaaagccatacaaaggatcggggtttagatgtatacacataggggagaaagtggacccagtgattgaacaagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctcttgaagcagaaagccatctcttcctcaatgcactctctgtatgggcttggcttgggtagccagcagcagccacagcaacagcagcagccagcccagccgccaccgccaccaccaccaccacagcagcaacaacagcagaaaacctctgctctttctcctaatgccaaggaatttatttttcctaatatgcagggtcaaggtagtagtaccaatggaatgttcccaggtgacagcccccttaacctcagtcctctccagtacagtaatgcctttgatgtgtttgcagcctatggaggcctcaatgagaantcttttgtagatggcttgaattttagcttaaataacatgcagtattctaaccagcaattccagcctgttatggctaactaaaaaaaagaaaatgtatcgtacaagttaaaatgcacgggcccaagggggattttttttttcacctccttgagaattttttttttnnnaagcttatagtaaggnatacattcaagnctnggttaaaaaaataataataaaacatgcatcatttttcattngccaaccaagcacaaagttattttatactgnactgntatatttnaaagtatactctcagatatggcctcttacagtatttaagatatagcaaggacatggctgatttttttttataaaaatnggcactaataagtgggttnatnggtcttttctaattgtataatttaatttagtacaaagtttgtaaaatatcagaggatatatatatattgtttctacgacatggtattgcatttatatctttttactacagtgatctgtgacagcagcagcttcatgttgtattttttttactgaaattgtaaaatatccatcttaaagacatcaactattctaaaaattgtgtacaggatattcctttagtggtggaattaaaatgtacgaatacttgctttttcaaaaaaatgtattttctgttaaaagtttaaagatttttgctatatattatggaagaaaaatgtaatcgtaaatattaattttgtacctatattgtgcaatacttgaaaaaaacggtataaaagtattttgagtcagtgtcttacatgttaagagggactgaaatagtttatattaagtttgtattaaaattctttaaaattaaaaaaaaaaaaaaaaaaaaaaaaaaannaana

SEQ ID NO: 118 - DNA, 1073 bp, Homo sapiens
cggagccagcgtgggaggccgctgccgtcgcgcgccttggtttttctgttccttttttttttttttttttaacttcctgcctatcacacgcagccatcagcccacaaagacatgactaccaacgcgggccccttgcacccatactggcctcagcacctaagactggacaactttgtacctaatgaccgccccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggttcgttctctactacgaagacctgcttggagaccaagccttcttatctcaactctggaaagagtatgccaagggagacagccgatacatcctgggtgacaacttcacagtgtgcatggaaaccatcacagcttgcctgtggggaccactcagcctgtgggtggtgatcgcctttctccgccagcatcccctccgcttcattctacagcttgtggtctctgtgggccagatctatggggatgtgctctacttcctgacagagcaccgcgacggattccagcacggagagctgggccaccctctctacttctggttttactttgtcttcatgaatgccctgtggctggtgctgcctggagtccttgtgcttgatgctgtgaagcacctcactcatgcccagagcacgctggatgccaaggccacaaaagccaagagcaagaagaactgaggagtggtggaccaggctcgaacactggccgaggaggagctctctgcctgccagaagagtctagtcctgctcccacagtttggagggacaaagctaattgatctgtcacactcaggctcatgggcaggcacaagaaggggaataaaggggctgtgtgaaggcactgctgggagccattagaacacagatacaagagaagccaggaggtctatgatggtgacgatttttaaaatcaggaaataaaagatcttgactctaaaaaaaaaaaa

SEQ ID NO: 119 - DNA, 1908 bp, Homo sapiens
  modified_base (58)..(59): a, c, g, or t
  modified_base (61)..(63): a, c, g, or t
  modified_base (563)..(563): a, c, g, or t
  modified_base (648)..(649): a, c, g, or t
  modified_base (1054)..(1054): a, c, g, or t
  modified_base (1711)..(1711): a, c, g, or t
  modified_base (1718)..(1721): a, c, g, or t
agcgcgcgtaatacgactcactatagggcgaattgggtaccgggccccccctcgagtnntnnntttttttttttgtatagagtaaaatttattatagggttgtagaattcatacaacctaaactccttacagcattcagcacctacacaattttgtgcattccacaatacagatagtagtgagaaagaatcactgcattagttaaaaatgactgtctcatgaaaattgttcacatataagtcaggttaattacagagcacctaacagaactgcaaagatgtaatttctaaattcaagaaagttgtacaaaatgaaaaacaaaagaaaccaacaatgttgagatctgatatattttacacaaaaagttcaaaaacaatttaaaatatttcaaattttaaaattgctgcaccataagatgaataaagagcttacttaaaggaaaagaaaaaacaaacaaacaaaaaaaacaacggatggaatttattgtcaggatgttaggtgatatattcatgctgctttcagaaatctaaaccctataaattcaaagaaaaaatgaaactcangtaatttcagtttcaaaaaacaagcaatgccaattaaactaaaatttgacaagagcttgcagtggttagtagttttttttttttnnttttttttaaagcataagcaatagagtaaatgcatgagtaaatatcttgagtatcccataaaccttaatgttaaagtcatattgtaaatctctgacttcttattaccaaggacactctatctgttgcctcttactcttgacagatcttggtctcaacaataaattcgttggggaagtgtctaatcttccagcatttatcaatggcacgtttgttgaaacccagcaagaggtctctgcgacgaaggcggaaggactttctgttattgcaaagttggtaaataaagatgccaaggttactaacatcacgaatttcctccacagcaactaggtcttctcgaaccacataagtttgaggcagatatctgccactcgccagtttgccaaagagctctaccagattttttnggaggcataacaatagaagtattgaggggcatcagatagcagttccccagcaacaagtccaggtaagcagtcattcccttttcaaagtcatgaataattgctgcagggtcactatcagagaaactggggacaggcacatcaatgattgcaatgttgtcatcctcacgaatgtcagcctcctcagtcacaggcaggaagttaggctctcctccacgaagggaatttgcaggatcctcagaatcaaaaaagcacatctctccacggtaaatggtgctcttgggcatgaagtacttgtaaatgcaggctccaccaacaataagtcctgccaagatgaatgaaaggcctaagagagtaagcatacatctcccagaggagccctctttttcctgggtggcaactcggagctccttgccggtcagtatctgagttctgaccgtgcggctcaggagggcctccacgtcttgccgcgcctcctccttttgcacggcggtaggggtattgaaggcgattttcaccatagtgaatcttcgggctgcgcggtaaggcgctgctggaatcagcgtcctgggctgcagactgcaagaggagatcctgttagcccaaacagcacttactttatcttcagtctaacactactgcaagccgaggtctgggatncttatgnnnnagtcccaaactggggggagaccgtgggcgggcccagggaggtgcctaaagggaggagcgagagggggcccaaaaggggcccaagtgcctgagttgggggtttgcgaggtggcgcggatttgccactgggggaagagcaggggaagtggagtccgtggccggctcaggctaaacgtgcctcacctgcc

SEQ ID NO: 120 - DNA, 3775 bp, Homo sapiens
cattcataagactcagagctacggccacggcagggacacgcggaaccaagacttggaaacttgattgttgtggttcttcttgggggttatgaaatttcattaatcttttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgcggcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctcggtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggatgaagggacgggggtgggaggtaggctgtggggtgggctggagtcctctccagagaggctcaacaaggaaaaatgccactccctacccaatgtctcccacacccaccctttttttggggtgcccaggttggtttcccctgcactcccgaccttagcttattgatcccacatttccatggtgtgagatcctctttactctgggcagaagtgagcccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaaggcagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgc

SEQ ID NO: 121 - DNA, 531 bp, Homo sapiens
ggcccttcagtatgcgcggacggaagatggcgtccgccacccgtctcatccagcggctgcggaactgggcgtccgggcatgacctgcaggggaagctgcagctacgctaccaggagatctccaagcgaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcaggtatcacttctagttttactttaaaaaataaaaaaatagagacagagtctcaaaaaaaaaaaaaaaaaaa

SEQ ID NO: 122 - DNA, 4152 bp, Homo sapiens
  modified_base (8)..(8): a, c, g, or t
  modified_base (303)..(303): a, c, g, or t
  modified_base (609)..(609): a, c, g, or t
  modified_base (906)..(907): a, c, g, or t
  modified_base (909)..(911): a, c, g, or t
  modified_base (913)..(914): a, c, g, or t
  modified_base (1928)..(1928): a, c, g, or t
  modified_base (2650)..(2651): a, c, g, or t
  modified_base (2718)..(2718): a, c, g, or t
  modified_base (2745)..(2745): a, c, g, or t
  modified_base (3489)..(3489): a, c, g, or t
  modified_base (3899)..(3899): a, c, g, or t
  modified_base (3954)..(3965): a, c, g, or t
  modified_base (4035)..(4035): a, c, g, or t
  modified_base (4049)..(4049): a, c, g, or t
agcggagngccgaaagcggagctcgaaactgactggaaacttcagtggcgcggagactcgccagtttcaaccccggaaacttttctttgcaggaggagaagagaaggggtgcaagcgcccccacttttgctctttttcctcccctcctcctcctctccaattcgcctccccccacttggagcgggcagctgtgaactggccaccccgcgccttcctaagtgctcgccgcggtagccggccgacgcgccagcttccccgggagccgcttgctccgcatccgggcagccgaggggagaggagccngcgcctcgagtccccgagccgccgcggcttctcgcctttcccggccaccagccccctgccccgggcccgcgtatgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagncaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggagacttctgaacgagagcgagaagcggcccttcgtggaggaggcggagcggctgcgcgtgcagcacaagaaggaccacccggattacaagtaccagccgcgnngnnngnngtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcggggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgangatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaanntaaaggccttattttgcaattatgggagtaaacaatagtctagagaagcatttggtaagctttatcntatatatattttttaaagaagagaaanacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaacaaaaaaaaattcttttttttttttttttttccaattttaccttctttaaaataggttgttggagctttcctcaaagggtatggtcatctgttgttaaattatgttcttaactgtaaccagtttttttttatttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctncatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctctttttttttttngtatattattgtttacaataaatatacattgcattaaaaaaaaaaaaaaaaaaannnnnnnnnnnnaaaaaaaaaaaaaaaaaaaaaggggggaaaaaaaaccaaaaagggccaaaaagggagaggaagaaaaaanaaaggcccggcggnaaaaaacggcagggcgggggaaaaacccgggcgaaaccaaacttggggggcgtggggggaacaatcccctttttttctcaattgtggtaaatggcctgaaaaa

SEQ ID NO: 123 - DNA, 4910 bp, Homo sapiens
tagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctcgacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgttaaa

SEQ ID NO: 124 - DNA, 783 bp, Homo sapiens
ggcacgagcgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgatgtctggcgataaagggatttctgccttccctgaatcagacaaccttttcaaatgggtagggaccatccatggagcagctggaacagtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttaaaaaaaaaaaaaaaaaaa

SEQ ID NO: 125 - DNA, 1967 bp, Homo sapiens
  modified_base (1289)..(1289): a, c, g, or t
  modified_base (1766)..(1766): a, c, g, or t
  modified_base (1915)..(1915): a, c, g, or t
  modified_base (1917)..(1920): a, c, g, or t
ggggggggggggcacttggcttcaaagctggctcttggaaattgagcggagagcgacgcggcttgttgtagctgccgctgcggccgccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatgtcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaantttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagntgcttatcttggctttcgagtctgagtttaaaactacacattttgacatagtgtttattagcagccatctaaaaaggctctaatgtatatttaactaaaattactagctttgggaattaaactgtttaacaaataaaaaaaaaaaaaanannnntacctataagcagcctaatttgaattatttgctccatctacatagtg

SEQ ID NO: 126 - DNA, 1220 bp, Homo sapiens
  modified_base (4)..(4): a, c, g, or t
  modified_base (9)..(11): a, c, g, or t
  modified_base (13)..(13): a, c, g, or t
  modified_base (16)..(16): a, c, g, or t
agcngagtnnnantcngccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgcccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcaaaaaaaaaaaaaaaaaaaaaaaaaaaaaaaaaaaaaaaaaaaac

SEQ ID NO: 127 - DNA, 728 bp, Homo sapiens
gcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattcttcaacagaaaaaaaaaaaaaaaaa

SEQ ID NO: 128 - DNA, 3138 bp, Homo sapiens
  modified_base (90)..(90): a, c, g, or t
  modified_base (129)..(129): a, c, g, or t
  modified_base (143)..(143): a, c, g, or t
  modified_base (149)..(149): a, c, g, or t
  modified_base (160)..(161): a, c, g, or t
  modified_base (164)..(164): a, c, g, or t
  modified_base (173)..(173): a, c, g, or t
  modified_base (187)..(187): a, c, g, or t
  modified_base (191)..(191): a, c, g, or t
  modified_base (195)..(195): a, c, g, or t
  modified_base (210)..(210): a, c, g, or t
  modified_base (231)..(231): a, c, g, or t
  modified_base (238)..(238): a, c, g, or t
  modified_base (242)..(242): a, c, g, or t
  modified_base (244)..(246): a, c, g, or t
  modified_base (272)..(273): a, c, g, or t
  modified_base (284)..(284): a, c, g, or t
  modified_base (363)..(363): a, c, g, or t
  modified_base (366)..(367): a, c, g, or t
  modified_base (685)..(685): a, c, g, or t
  modified_base (694)..(694): a, c, g, or t
  modified_base (700)..(700): a, c, g, or t
  modified_base (711)..(711): a, c, g, or t
  modified_base (724)..(724): a, c, g, or t
  modified_base (1658)..(1658): a, c, g, or t
  modified_base (3115)..(3115): a, c, g, or t
  modified_base (3118)..(3120): a, c, g, or t
agacaatttttctgaaatttttcttctctcaagcttcttggcctgacaagcataagtgcctctgccttccttcgccgcacctctcgccanccgccgcctctgcggcttacttgaaggcttgcttgcttnttgccgccgccgcngccgcngccgccgcttnngcntgcccacancgctcccgagctanggancaangccccatccgagcgncgtgggcgtcgtaggggaganggagggncggntnnnctccgctgcaacagcaaagtttgagnncgaagcctagncgactcgcagcgccggtcccgcagtttcacctcttttttttttaactccgccagaggaccccgacccacaggtcccggnttnntccgctggtcaaagtgcgtgcggagtagttggcaaagttgagagcggagacgtctctgggaacagctgtttgcgttccgggcggaggcggcgcgctgagctccttggccttgagccagcgagcctagaaggaggatggaggttttgggccccaggggaggacacagagacggcgggatggcgcagggacttgaggcttgagatcccgtccttcagctcaggtcccgtcgcgcttttaccccttcccggtgacctcaacccctttataccgaccccacctctttggagccgggagtaccgcccctgtagggggaggggnagaggaggngatttngaacgcggatnggatcgtctgggnacccgtagttgggaacagcggaacgctggtcccggggactgagtaaggtgtctggatcggagggaggttcgggtgggcatcgggcggctggaagagctcgactcgtcccgctgggaaagcgcgagtctgagtggaaccctggacgacttgcagagcggctggcgcagtcatggcggactactggaagtcacagccaaagaaattctgtgattactgcaagtgctggatagcagacaataggcctagtgttgaatttcatgaaagaggaaagaatcataaggaaaatgtggcaaaaaggatcagtgagattaaacagaaaagcctggataaggcaaaggaagaagaaaaggcatcaaaggagtttgctgcaatggaggcagctgccctgaaagcataccaagaggatttgaaaagacttggcttagagtcagaaattttggagccaagcataacaccagtaaccagcactatcccacctacctcgacatcaaatcaacagaaagaaaagaaagaaaagaagaaaagaaaaaaagatccttcaaagggcagatgggtagaaggcataacctctgagggttaccattactattatgatcttatctcaggagcatctcagtgggagaaacctgaaggatttcaaggagacttaaaaaagacagcagtgaagaccgtttgggtagaaggtttaagtgaagatggttttacctattactataatacagaaacaggagaatccagatgggagaaacctgatgatttcattccacacactagtgatctgccttctagtaaggtcaatgaaaattcacttggcaccctagatgaatccaaatcatcagattcgcatagtgattctgatggggaacaggaagcagaagaaggaggggtctctacagagacagaaaagccaaaaataaagtttaaggaaaaaaantaaaaatagtgatggaggaagtgacccagaaacacagaaagaaaaaagtattcagaaacagaattcattaggttcaaatgaagaaaaatcgaaaactcttaagaaatcaaacccatatggagaatggcaagaaattaaacaagaggttgagtctcatgaggaggtagatttggaacttccaagcactgaaaatgagtatgtatcaacttcagaagctgatggtggcggagaacccaaagtggtatttaaagaaaaaacagtcacttctcttggagttatggcagatggagtggccccagtcttcaaaaagagaagaactgaaaatggaaaatctagaaatttaaggcaacgaggtgatgatcaatagttgcaggagagctttttgtacatgcttttaggacagaatggagacttatacacccaaagtttatctgtgtttgtttgtaagtattatgatgctaaaaatttagatttattctaaatgtatttgatgtgaattaaaataaatattttttcatgtgaaatttattttggttcctaaaatggaagcctaccacattgcattgtaatacagtgtattatgttcagtgtctaaaaactgctaattaagtcataatttaagatgctatgtatctgttatttaaaacatggagaaacagggcctttattccattcatattcataagagcatatttatcctgcattgaaaatgcattacttttgcacattgatattaactgttgtccaacaaataagtatcggagtacgtgagaatattcccagcccagtgatgatttggttctgaggctgatgtgagaaagctgatgtaaaaaatgtatgcatattggcttaccttactcaatttaaagtcaaaagccaacagccaggagcagctcaggtacttcagatgtgcttaatatggagtgaaaactggaccagaggtggaaagatgtatttgccccagttcacttcaaagcagcaaacgttgtttaagcattttagtttgaaccaggcattgtgttaggaatccagggataaagatgaatgaaatgtatttctgttcttcaggagttcacattctagcatatgccttttttcccccagtcatgcactctttttagcagtcttatatgtactagaaaagattttttaaagtttatttaaagctgtgtagatgaaggcttgatctaaaatagtataaggtctccagcttcagtaaaagtttttagtgtttacttaaattagtaatttctcactttctgtctggttaaaatgtcttaaaaagtagaattttcttctttaatccgtttagtagttacctcccttttacttttcaaattcacaaaattacatttctcataaattgtatagtatttaacttataatagttaatatttgtctttttaagatgactgtacatgtaagaaaaaagcttattaaaaacttgatcaaagaanaannnaaaaaaaaaaaaaaagtt

SEQ ID NO: 129 - DNA, 2907 bp, Homo sapiens
  modified_base (1894)..(1894): a, c, g, or t
  modified_base (1990)..(1990): a, c, g, or t
  modified_base (2388)..(2388): a, c, g, or t
  modified_base (2506)..(2506): a, c, g, or t
  modified_base (2509)..(2509): a, c, g, or t
ggaattcggcacgagggacggcgggccccgcttccggcccgggcgtcgtgcgtgacccagcggcgtcacagccgaggaagcggcccggccgggagggcggggaggcgcgcggcgatcggacacgatggcgggaggaggcgggagtagcgacggcagcgggcgggcagctggcaggcgggcgtcccgcagtagcgggcgggcccggcgggggcgccacgagccggggctggggggcccggcggagcgcggcgcgggggaggcacggctggaagaggcagtcaatcgctgggtgctcaagttctacttccacgaggcgctgcgggcctttcggggtagccggtacggggacttcagacagatccgggacatcatgcaggctttgcttgtcaggcccttggggaaggagcacaccgtgtcccgattgctgcgggttatgcagtgtctgtcgcggattgaagaaggggaaaatttagactgttcctttgatatggaggctgagctcacaccactggaatcagctatcaatgtgctggagatgattaaaacggaatttacactgacagaagcagtggtcgaatccagtagaaaactggtcaaggaagctgctgtcattatttgtatcaaaaacaaagaatttgaaaaggcttcaaaaattttgaaaaaacatatgtccaaggaccccacaactcagaagctgagaaatgatctcctgaatattattcgagaaaagaacttggcccatcctgttatccagaacttttcatatgagaccttccagcagaagatgctgcgcttcctggagagccacctggatgacgccgagccctacctcctcacgatggccaaaaaggctttgaaatctgagtccgctgcctcaagtacagggaaggaagataaacagccagcaccagggcctgtggaaaagccacccagagaacccgcaaggcagctacggaatcctccaaccaccattggaatgatgactctgaaagcagctttcaagactctgtctggtgcacaggattctgaggcagcctttgcaaaactggaccagaaggatctggttcttcctactcaagctctcccagcatcaccagccctcaaaaacaagagacccagaaaagatgaaaacgaaagttcagccccggctgacggtgagggtggctcggaactgcagcccaagaacaagcgcatgacaataagcagattggtcttggaggaggacagccagagtactgagcccagcgcaggcctcaactcctcccaggaggccgcttcagcgccaccatccaagcccaccgttctcaaccaacccctccctggagagaagaatcccaaagtacccaaaggcaagtggaacagctctaatggggttgaagaaaaggagacttgggtggaagaggatgaactgtttcaagttcaggcagcaccagatgaagacagtacaaccaatataacaaaaaagcagaagtggactgtagaagaaagcgagtgggtcaaggctggagtgcagaaatatggggaaggaaactgggctgccatttctaaaaattacccatttgttaaccgaacagctgtgatgattaaggatcgctggcggaccatgaaaagacttggcatgaactgaaacaggctttcatttccacagaattcacaggagcatggttcctaataatagcccctgatagtctgctctttctttctttttcttttttttttttttttgagacagagtctcgctctgtcacccaggctggagtgcagtggcgtgatctcggctcactgcgacctccgtctcccgggctcacgccattctcctgcctcagcctccgagtagctgggactacaggcgcccgccatcacgcccggctaatgttttgtatttttagtaaanacggggtttcaccgtgttggccaggatggtctcgatctcctgacctcgtgatccacccaactcggcctcccaaagtgctgggattacaggcatganccaccgcgcctggcatctgctgtttctttcagaagctgggctgggatgagaattttgggcaacctccttcgacgtgggggaggtcccatttccacttcatcactgttggagatcatggagctaagaagcagagccaagtccacccatgtccttggcagagatgacggcacacagcttgtgcagtgccagaatatcattagcgtttcccttctttagtggtttgcttaaatttaaatccctggtaatctgtagaaccttctcctaggaaatggtgaagtctattaggagccacttgtgactccatgacctgttaaaaccagcaatgtgagtattatttggagtaaatttgttccacgtcaagttctggccttctgatgcaaatgcaaaggaacttagtntgttatgaacccaggttgatgacagaccagtccttgtggaataagattccctttaaaaactctttagccagtcgtgacatcaaccctagacctgtctgccttggcatttgctgtcaanatntgctgggctatgtaggcaggttaatcctccacttctcatgtggttgaaccagtgtgttttttggtaaaatggtgattgtagataagattagttccctgatcccctgccccctgtcccctgcctcttttcccaattcccttccttatgctggacttttaaagcttaaaaaaaatccgattgaatataaatgcctaatttcattcttttgtgaaatggttgcttcctcctgattccctaattgtgctgtgttcgtgtcttgcactggaattcaacattcccttctccttttgtactgtgttgtgcttgctgtctctcccggacacccttaaagactgtctttttagcaaaaaatttcagtaaagtgttttctgtaatctttttttaaaaaaaaaaaaaaa

SEQ ID NO: 130 - DNA, 1044 bp, Homo sapiens
tgctgctctcctcccgctccgtcctcctcgcctgccaccggtgcacccagtccgctcacccagcccagtccgtccggtcctcaccgcctgccggccggcccaccccccaccgcaggccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagtattccaccaaagaagataaatatgaagaggagatcaaactgttggaggagaagctgaaggaggctgagacccgagcagagtttgccgagaggtctgtggcaaagttggagaaaaccatcgatgacctagaagagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctc

SEQ ID NO: 131 - DNA, 2148 bp, Homo sapiens
gcttcagggtacagctcccccgcagccagaagccgggcctgcagcccctcagcaccgctccgggacaccccacccgcttcccaggcgtgacctgtcaacagcaacttcgcggtgtggtgaactctctgaggaaaaaccattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagcaaaaaaaaaaaaaaaaaa

SEQ ID NO: 132 - DNA, 591 bp, Homo sapiens
cagaacggccgatctccagcccaagatgattccagcagtggtcttgctcttactccttttggttgaacaagcagcggccctgggagagcctcagctctgctatatcctggatgccatcctgtttctgtatggaattgtcctcaccctcctctactgtcgactgaagatccaagtgcgaaaggcagctataaccagctatgagaaatcagatggtgtttacacgggcctgagcaccaggaaccaggagacttacgagactctgaagcatgagaaaccaccacagtagctttagaatagatgcggtcatattcttctttggcttctggttcttccagccctcatggttggcatcacatatgcctgcatgccattaacaccagctggccctacccctataatgatcctgtgtcctaaattaatatacaccagtggttcctcctccctgttaaagactaatgctcagatgctgtttacggatatttatattctagtctcactctcttgtcccacccttcttctcttccccattcccaactccagctaaaatatgggaagggagaacccccaataaaactgccatggactggactc

SEQ ID NO: 133 - DNA, 2981 bp, Homo sapiens
  modified_base (16)..(16): a, c, g, or t
  modified_base (50)..(50): a, c, g, or t
  modified_base (1286)..(1286): a, c, g, or t
  modified_base (1313)..(1314): a, c, g, or t
  modified_base (1319)..(1319): a, c, g, or t
  modified_base (1333)..(1333): a, c, g, or t
  modified_base (1348)..(1350): a, c, g, or t
  modified_base (1352)..(1352): a, c, g, or t
  modified_base (1354)..(1358): a, c, g, or t
  modified_base (1360)..(1362): a, c, g, or t
  modified_base (1364)..(1364): a, c, g, or t
  modified_base (2133)..(2133): a, c, g, or t
  modified_base (2740)..(2740): a, c, g, or t
  modified_base (2774)..(2778): a, c, g, or t
gaagacgctcagaggnattctgacaatatctttaccggagaagaggcaangtacgctcaaagccgaagccacagctcctcctgccgcatttctttcctgcttgcgaattccaagctgttaaataagatgtgcaaagggcttgcaggtctgccggcttcttgcttgaggagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaaataatggcctggtaggtctggattttcaaagattgttggcagtttcctcctcccaacagttttacctcgggatggttggttagtgcatgtcacatgacatccacatgcacatgtattctgttggccagcacgttctccagactctagatgtttagatgaggttgagctatgatatgtgcttgtgtgtatgtctatgtgtatatattatatatacattagacacacatatacattatttctgtatatagatgtctgtgtatacatatgtatgtgtgagtgtatgtanacacacacacacacacacacacacttnngcaanagtgatgggaaagnccctaggtgctcatnnntngnnnnngnnnangtacttacatgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttactggctgagtgagggcatagaagttaaaggttactgtttttatcctctatccttttttcctttcctgatcaaggtgctcttctcattttttcctgagaaccttagccatcagatgaggctccttagtttattgtggttggttgttttttctttataatggctctgggctatatgcccatatttataaaccagcagcaggggaaagattatattttataagagggaacaaattttcacaatttgaaaagcccacataagttttctcttttaaggtagaatcttgttaatttcattccaaacatcggggctaacagagactggaggcatttctttttaggctctgagactaaatgagaggaaaanaaaagaaaaaaaaatgattgtctaaccaattgtgagaattactgtttgaaacttttcaaggcacattgaaatacttgaaaacttctcatttatgttatttatgatgttattttgtacgtgttattattattatattgttttataaatggaggtacaggatatcacctgaattattaatgaatgcccaggaagtaattttcttctcattcttctaaaactactgcctttcaaagtgcacacacacgcgtccacatacactgcattcgttgctccagtataaattacatgcatgagcacctttctggcttttaagccaatataatgggctgcaaaatgaagacaccagagtgtatgcatacaaatctcactgtattaaagatgcaggttttctaattgtacccttcttgtctctctggcaatcttgcccttaatatccctggagttcctcatcagtgtcattttctgttatacacagttccacaattttgtctctagttgacttcaaatgtgtaactttattggtcttgccctattataattgtcatgactttcagattgtatctgaactcacagactgctgtcttactaataggtctggaaggtcacnctgaatgagaagtaaattattttatgtaatacannnnngagtgtgtttttcagttgtatttccctgttatttcatcactatttccaatggtgagcttgcctgctcatgctccctggacagaatactccttccttttgcatgcctgtttctatcatgtgcttgataggcctcaaagctaatgcttccagtgaaacacacgcatcttaataataagggtaaataaacgctccatatgaaacta

SEQ ID NO: 134 - DNA, 371 bp, Homo sapiens
ggacagaggaggactacgcgtgtccttgggcggagaagggaggtgactccggcggaagaggacaaggcagaatgcaggcccttcgggtgtcccaggcgctgatccgctccttcagctccaccgcccggaaccgctttcagaaccgagtgcgcgagaaacagaagctcttccaggaggacaatgacatcccgttgtacctgaagggcggcatcgttgacaacatcctgtaccgagtgacaatgacgctgtgtctgggcggcactgtctacagcttgtactcccttggctgggcctccttccccaggaattaagaccaagaagcctggggggcctgagagacttgaacaagtgtcaataaacgctggcctctg

SEQ ID NO: 135 - DNA, 1900 bp, Homo sapiens
acaactctcagaggagcattgcccgtcagacagcaactcagagaataaccagagaacaaccagattgaaacaatggaggatctttgtgtggcaaacacactctttgccctcaatttattcaagcatctggcaaaagcaagccccacccagaacctcttcctctccccatggagcatctcgtccaccatggccatggtctacatgggctccaggggcagcaccgaagaccagatggccaaggtgcttcagtttaatgaagtgggagccaatgcagttacccccatgactccagagaactttaccagctgtgggttcatgcagcagatccagaagggtagttatcctgatgcgattttgcaggcacaagctgcagataaaatccattcatccttccgctctctcagctctgcaatcaatgcatccacagggaattatttactggaaagtgtcaataagctgtttggtgagaagtctgcgagcttccgggaagaatatattcgactctgtcagaaatattactcctcagaaccccaggcagtagacttcctagaatgtgcagaagaagctagaaaaaagattaattcctgggtcaagactcaaaccaaaggcaaaatcccaaacttgttacctgaaggttctgtagatggggataccaggatggtcctggtgaatgctgtctacttcaaaggaaagtggaaaactccatttgagaagaaactaaatgggctttatcctttccgtgtaaactcggctcagcgcacacctgtacagatgatgtacttgcgtgaaaagctaaacattggatacatagaagacctaaaggctcagattctagaactcccatatgctggagatgttagcatgttcttgttgcttccagatgaaattgccgatgtgtccactggcttggagctgctggaaagtgaaataacctatgacaaactcaacaagtggaccagcaaagacaaaatggctgaagatgaagttgaggtatacataccccagttcaaattagaagagcattatgaactcagatccattctgagaagcatgggcatggaggacgccttcaacaagggacgggccaatttctcagggatgtcggagaggaatgacctgtttctttctgaagtgttccaccaagccatggtggatgtgaatgaggagggcactgaagcagccgctggcacaggaggtgttatgacagggagaactggacatggaggcccacagtttgtggcagatcatccttttctttttcttattatgcataagataaccaactgcattttatttttcggcagattttcctcaccctaaaactaagcgtgctgcttctgcaaaagatttttgtagatgagctgtgtgcctcagaattgctatttcaaattgccaaaaatttagagatgttttctacatatttctgctcttctgaacaacttctgctacccactaaataaaaacacagaaataattagacaattgtctattataacatgacaaccctattaatcatttggtcttctaaaatgggatcatgcccatttagattttccttactatcagtttatttttataacattaacttttactttgttatttattattttatataatggtgagtttttaaattattgctcactgcctatttaatgtagctaataaagttatagaagcagatgatctgttaatttcctatctaataaatgcctttaattgttctcataatgaagaataagtaggtaccctccatgcccttctgtaataaatatctggaaaaaacattaaacaataggcaaatatatgttatgtgcatttctagaaatacataacacatatatatgtctgtatcttatattcaattgcaagtatataataaataaacctgcttccaaacaac

SEQ ID NO: 136 - DNA, 2222 bp, Homo sapiens
gagtcccggcagtgcgggactccggtagccgcccctccggtagccgcccctcctccccccgcgccgccgccctatatgttgcccgccgcggcctctggggcatggagcacgctgcccagccctggcgatggcaacggcgacgggggtggcggaggagcgcctgctggccgcgctcgcctacctgcagtgcgccgtgggctgcgcggtcttcgcgcggaatcgtcagacgaactcagtgtacggccgccacgcgctgcccagccacaggctccgagtgccggcgcgggccgcctgggtggtgcaggagctgccctcgctggccctgccgctctaccagtacgccagcgagtccgccccgcgtctccgcagcgcgcccaactgcatcctcctggccatgttcctcgtccactacgggcatcggtgcttaatttacccgtttctgatgcgaggaggaaagcctatgccactgttggcatgtacaatggcgattatgttctgtacctgtaacggctatttgcaaagcagatacttgagccattgtgcagtgtatgctgatgactgggtaacagatccccgttttctaataggttttggcttgtggttaacaggcatgttgataaacatccattcagatcatatcctaaggaatctcagaaaaccaggagatactggatacaaaataccaaggggaggcttatttgaatacgtaactgcagccaactattttggagaaatcatggagtggtgtggctatgccctggccagctggtctgtccaaggcgcggcttttgctttcttcacgttttgttttttatctggtagagcaaaagagcatcatgagtggtacctccggaaatttgaagagtatccaaagttcagaaaaattataattccatttttgttttaagtgcgtttttcatgaaattatcttcaacttgaagctttccaatggcgcttctctatggactttgtaaataagttatatctttgtaattttcctgctactttatcattttcaagatgtcctctaggaattttttttctagtaattttgcaatctacctaataagtacctaaatacgctgaaatggaggttgaatatcctactgtgtaacaggtcagaatttcaagctctgggtaataactgctgatattttttctaatttcaaatttacctcttttggctatgtcttgccaagtgtgtatgagactagactttacaactgtctttgatggcattttcagaacaataaatgtcacaatcccttctatagccccctacagtgatctcttcaaggtcaactgcagtgttgcttccctccccctatagggctggaatctgtctaggagccctctctcggaggccatagaggctgggggtagccattgtgcagtcatggcccgggggaaacttgccaaccttcgtgtcaggtgctgtgtataagtggagaacttggggatagaggaggaagctcctcgtggcccttccaaggtgaggcaaaggcatctggacttgttccagcccagcccaccgggtgacatcaccgggcagggaggggtgctggtggtggttcatacggagtaagctgctctgcctgtgtgagtggctcctgggccctaaacaggcacctttaggccatgggtcactcaccgtgagccatcaatgtgctctggtctgacatggtttctctctgtcttctagtctagacctagtttttttgttctgttccccacgtatggatatagtagagattgttgtctgtgaaatttctcttttgtagattttgagttttcccttgtagtgtaaagaatgatcactttctgtaacaataacaagaccactttttaagatttatcctgtttgttctttgttgattgaaacataataattgttaaaattctctacagccttctttttcttccatagctaatcttccttctaatagtttttgctttctgttttgctgttgttgctttgcaaagctttcccctcatagcctgtacctgttatcaatataaaataatcttcctgttgaatgcttcatgacttgaattctactttgataaaaacattgccatactgctttttatcttgatgaattcatctggcattgctttgccttatcatctcatctggagtttttaaatgccatttgtttcagttgtctttaacaacataataaatagactttgccatttaaaaaaaaaaaaaaaaaaaaaaa

SEQ ID NO: 137 - DNA, 1443 bp, Homo sapiens
gtggctgcagcagcagcggcggcggaaaccctaaagtccgagtccggactacgagtgcgtggcctcctaatccggatcctagtcctgagcgtgtctgtgtgcgagtggacggtcccggacgcgatgaccctgaacggcggcggcagcggagcgggcgggagccgcggtgggggccaggagcgcgagcgccgtcggggcagcacaccctggggccccgccccgccgctgcaccgccgcagcatgccggtggacgagcgcgacctgcaggcggcgctgaccccgggtgccctgacggcggccgcggccgggacggggacccagggtcccaggctggactggcccgaggactccgaggactcgctcagctcagggggcagcgactcagacgagagcgtttacaaggtgctgctgctgggggcgcccggcgtgggcaagagcgccctggcgcgcatcttcggcggtgtggaggacgggcctgaagcagaggcagcagggcacacctatgatcgctccattgtagtggacggagaagaggcatcactcatggtctacgacatttgggagcaggacgggggccgctggttgcccggccactgcatggccatgggggatgcctatgtcattgtgtactcagtgacggacaagggcagcttcgagaaggcctcagaactgcgggtccagctgcggcgtgcacggcaaacagatgatgtgcccatcatcctcgtgggcaacaagagcgacctggtgcgctctcgtgaggtctcggtggatgagggccgggcctgcgcggtggtctttgactgcaagttcattgagacatcagcggcattgcaccacaatgtccaggcgctgtttgaaggtgtcgtgcgccagatacgcctgcgcagggacagcaaagaagccaacgcacgacggcaagcaggcacccggaggcgagagagccttggcaaaaaggcgaagcgcttcttgggccgcatcgtagctcgtaacagccgcaagatggcctttcgcgccaaatccaagtcctgccacgacctctcggttctctaggtcccacccgctcccactatggtgggagacgaacggaagggttggtgggctggcccagccaactgccccgggtgcctcagagcaggctcagactctgggtccctcggagctgccagccgggcacccccaacctcatggtcatggacagatagacagtgctgccctgcgaagtggctctcaggggccagtgagggctgggcccacagagatgcatgcgcaggctcatatgcgtcccaagcagccgcagcgcagccgccgggcaggcctgcgtgccgggagaggactctgccttttttcacagcccgggtgtgcctgccctggagggaggctcttcagtgcggtagctacttgtttacatgcagatttttgtaataaaggctatttcctgataaa

SEQ ID NO: 138 - DNA, 1443 bp, Homo sapiens; identical to SEQ ID NO: 137

SEQ ID NO: 139 - DNA, 1670 bp, Homo sapiens
attgagagtggctctaacaagtgccatttttccttgttagctttcatttctcagccctttacaagattaaaatagtctgcagtttaatctctccaaagctttacggacagtgattctgtcctaaacaagacagtgactccaggatttctgaagactattgtggaagaagcatccattaaggccaagctataacatcagaaatggtgaatgaatacaagaaaattcttttgctgaaaggatttgagctcatggatgattatcattttacatcaattaagtccttactggcctatgatttaggactaactacaaaaatgcaagaggaatacaacagaattaagattacagatttgatggaaaaaaagttccaaggcgttgcctgtctagacaaactaatagaacttgccaaagatatgccatcacttaaaaaccttgttaacaatcttcgaaaagagaagtcaaaagttgctaagaaaattaaaacacaagaaaaagctccagtgaaaaaaataaaccaggaagaagtgggtcttgcggcacctgcacccaccgcaagaaacaaactgacatcggaagcaagagggaggattcctgtagctcagaaaagaaaaactccaaacaaagaaaagactgaagccaaaaggaataaggtgtcccaagagcagagtaagcccccaggtccctcaggagccagcacatctgcagctgtggatcatcccccactaccccagacctcatcatcaactccatccaacacttcgtttactccgaatcaggaaacccaggcccaacggcaggtggatgcaagaagaaatgttccccaaaacgacccagtgacagtggtggtactgaaagcaacagcgccatttaaatacgagtccccagaaaatgggaaaagcacaatgtttcatgctacagtggccagtaagactcaatatttccatgtgaaagtcttcgacatcaacttgaaagagaaatttgtaaggaagaaggtcattaccatatctgattactctgaatgtaaaggagtaatggaaataaaggaagcatcatctgtgtctgactttaatcaaaattttgaggtcccaaacagaattatcgaaatagcaaataaaactcccaagatcagtcaactttacaagcaagcatctggaacaatggtgtatgggttgtttatgttacaaaagaaaagcgtacacaagaagaacacaatttatgaaatacaggataatacaggatccatggatgtagtggggagtggaaaatggcacaatatcaagtgtgagaaaggagataaacttcgactcttctgccttcaactgagaacagttgaccgcaagctgaaactggtgtgtggaagtcacagcttcatcaaggtcatcaaggccaagaaaaacaaggaaggaccaatgaatgttaattgaaatatgaaagctgaaatgcaacaaacaacttccgcttaaaacaattaagttgttaataactgtgattttgtaaatttcagtaattcatttaaatgatgtttcagtagatatattctagcatattaagagcttttataactgagttatagattagtttgctttctggaataaaattttcttcttatactcttccttttttttagatattacattttgcttttatgacattcacgaggcaaaaaaccg

SEQ ID NO: 140 - DNA, 787 bp, Homo sapiens
ctgaaggtcacccgggcggccccctcactgaccctccaaacgcccctgtcctcgccctgcctcctgccattcccggcctgagtctcagcatggcggatgggagcagcgatgcggctagggaacctcgccctgcaccagccccaatcagacgccgctcctccaactaccgcgcttatgccacggagccgcacgccaagaaaaaatctaagatctccgcctcgagaaaattgcagctgaagactctgctgctgcagattgcaaagcaagagctggagcgagaggcggaggagcggcgcggagagaaggggcgcgctctgagcacccgctgccagccgctggagttgaccgggctgggcttcgcggagctgcaggacttgtgccgacagctccacgcccgtgtggacaaggtggatgaagagagatacgacatagaggcaaaagtcaccaagaacatcacggagattgcagatctgactcagaagatctttgaccttcgaggcaagtttaagcggcccaccctgcggagagtgaggatctctgcagatgccatgatgcaggcgctgctgggggcccgggctaaggagtccctggacctgcgggcccacctcaagcaggtgaagaaggaggacaccgagaaggaaaaccgggaggtgggagactggcggaagaacatcgatgcactgagtggaatggagggccgcaagaaaaagtttgagagctgagccttcctgcctactgcccctgccctgaggagggccactgaggaataaagcttctctctgagctg

SEQ ID NO: 141 - DNA, 1599 bp, Homo sapiens
cactgcttattaaagtacactattcaggcatatcatgtaggtttactttctgtgtttctagagaccaagaagcgggacgttcaccatgggaagaaaatcgctgtaccttctgattgtggggatcctcatagcatattatatttatacgcctctcccagataacgttgaggagccatggagaatgatgtggataaacgcacatctgaaaactatacaaaatttggctacatttgtggagctccatgggagttccatttttatggattcctttaaggttgtcgggagctttgatgaagtcccaccaacctcagatgaaaatgtcactgtgactgagacaaaattcaacaacattcttgttcgggtatatgtgccaaagagaaagtctgaagcactaagaagggggttgttttacatccatggtggaggctggtgcgtgggaagtgctgctctaagtggttatgacttgctgtcaagatggacagcagacagacttgatgctgtcgtcgtatcaaccaactacagattagcacctaagtatcatttcccaattcaatttgaagatgtatataatgccttaaggtggttcttacgtaaaaaagttcttgcaaaatatggtgtgaaccctgagagaatcggtatttctggagatagtgcaggagggaatttagctgcagcagtgactcaacagctccttgatgacccagatgtcaagatcaaactcaagatccagtctttaatttatcctgcccttcagcctcttgatgtagatttaccgtcatatcaagaaaattcaaattttctatttctatccaaatcactcatggtcagattctggagtgaatattttaccactgatagatcacttgaaaaagccatgctttccagacaacatgtacctgtggaatcaagtcatctcttcaaatttattaattggagttccctgctccctgagaggtttataaaaggacatgtttataacaatccaaattatggcagttctgagctggctaaaaaatatccagggttcctagatgtgagggcagcccctttgttggctgatgacaacaaattacgtggcttacccctgacctatgtcatcacctgtcaatatgatctcttaagagatgatggactcatgtatgtcacccgacttcgcaacactggggttcaggtgactcataaccatgttgaggatggattccatggagcattttcatttctgggacttaaaattagtcacagacttataaatcagtatattgagtggctaaaggaaaatctatagtaaaacatgtagctataacatattttaaaaataaaatctgaaaacctcagaaaatttcgattagaaattggtctttcttagaatggtctagttaagttccacatgtagcataattcttaaataggcacttttctgttttttttttcttactgtgggatttcatttcaattttctacattgtctatctgctttttcggagattttccttcttacactgttaatcttattttaaaaaatattacattcttgtatactttatttttgtgagttggctactatttacgatgcaagagaataaatgtgagcaaagattg

SEQ ID NO: 142 - DNA, 787 bp, Homo sapiens; identical to SEQ ID NO: 140

SEQ ID NO: 143 - DNA, 1599 bp, Homo sapiens; identical to SEQ ID NO: 141

SEQ ID NO: 144 - DNA, 400 bp, Homo sapiens
ccactagccaagccgcgcgtccagttgcttgaagaagcccgttcaccgcctccagctgctgctctcctcgacatggaccctgagacctgcccctgcccttctggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgaaggcacccctccgtgtggagcactggagatagtgccaggtggctcagtgcccacctatgccctgtggtgaagtgttcctggtgttccctttccctgctgaccttggaggaatgacaataaa

SEQ ID NO: 145 - DNA, 4289 bp, Homo sapiens
gatcaatactgaggccgcgtcgacccccttgagccgagacccccccccagcccagcccccaccccaccccccgcacacgccccaccccccccacgacccagcctcataccgcaccagctgaggcacccaagaggattaccccctggggccctctcccgccccccaaaaaagagaagatcccctctcctggcccatcccttcccttcttccctcccccctccccccgaactttccctctcgcatgcttttcccctgcaccacggatcgcctctcggatgccgcttgcctggaagctgcgttaggagcgagcggcggcggtggcggcggtggcggcggcggcggcagctcgggagtgctatgaccggcaaactcgccgagaagctgccggtgaccatgagcagtttgctaaaccaactgcctgacaatctgtaccccgaggagatccccagcgcgctcaacctcttctccggcagcagcgactcggtagtccattacaatcagatggctacagagaatgtaatggacatcggtctgaccaacgagaagcccaacccggaactctcttactccggctccttccagccagcccccgggaacaagaccgtgacctacttgggaaagttcgccttcgactccccttccaactggtgccaggacaacatcattagcctcatgagcgccggcatcttgggggtgcccccggcttcaggggcgctaagcacgcagacgtccacggccagcatggtgcagccaccgcagggtgacgtggaggccatgtatcccgcgctacccccctactccaactgcggcgacctctactcagagcccgtgtctttccacgacccccagggcaatcccgggctcgcctattccccccaggattaccaatcggccaagccggcgttggacagcaatctcttccccatgattcctgactacaacctctaccaccaccccaacgacatgggctccattccggagcacaagcccttccagggcatggaccccatccgggtcaacccgccccctactacccctctggagaccatcaaggcattcaaagacaagcagatccacccgggctttggcagcctgccccagccgccgctcaccctcaagcccatccggccccgcaagtaccccaaccggcctagcaagacaccgctccacgaacggccccacgcgtgcccggccgagggctgcgaccgccgtttcagccgttcggacgagctgacccggcacctgcgcatccacacgggccacaagcccttccagtgccggatctgcatgcggagcttcagccgcagcgaccacctcaccactcacatccgcactcatacgggcgagaagccctttgcctgcgagttctgcgggcgcaagtttgcgcgcagcgacgagcgcaagcgccacgccaagatccacctcaagcaaaaggagaagaaggcggagaagggcggtgcaccctctgcatcctcggcgccccccgtgtcgctggcccccgtggtcaccacctgcgcctgaggatcgggcccccagatccccacttttcccctccagtgcctcccggctgctagcctgaaagcagcgggaaagccagccacggaggcgtaggggccgcgccctggcctctccatggacgtgcggccccttgcttccccttcgatgcccccggttcccaacctttcacgccggccagcggtcaggggccagggctggaggcgccttcccctcgcggtcccccacttagccaaggcgtgggggcggaaaggtggcgtctagcccgctttgttcagttcggatcgccttgatccaggggccgccgggccgcgccaaggacctgcaagggactgaaggcggagcccatccaaccctcgcccgacccaaacacctcattgtttcccccacgtctccctctataccccctcgaagactcgagagggggagggggtaaggagcgcaccaaagcgcagagcttgctgcccgccgcacgcacgcgcgcctgcgtgcggggatgcgcgcgagtgtgtgcgtgctcgcgtgtgtgtgtatgtgtgtgtgtgagtgtgtgtgtgtgcgcgcgcgcaagcgtgtgtgtttaagactcttgagctgaactgggctgtgtttaccccaaactcttccccacctcgggtccccaagccgctgggagatgtcccatgctgggggtccgcacgtggctggaggaggtggtcttccatccgctctgaaatcatgtttcttagagaaatgcctcggatgccgccgacgcggtgctgctgccgccgcttcgggtttggcccctcagaacccctccttttctgagcgcttccctcttaggcctcagggcagtttgatctgtggggagaaagagcagccatcgctgagcctgccttttaaaatatatgtgtatttccttagccccactctaagaaatctatgttcctgagtttgccccctgccctcccactccttccccttttcccctctaaaccttctcccatctctttcaaaatcttttcccagaaaggcaggcttcaaccagccactccagctttgtgtcttctctcaattacatagcaatttctccttcccaccatcatggggaagctggctctgcttttgccctttgtcatcaccaacacaacagatagaatttaaatataagtatatggtgtgcgtgtgtatgtatgtgtatgtatatgcatgcatgtgtataaagatgcacatgcgtacatatacataacatacacacaatatgtattcctagcaaaataaaatctctaaggtacttggttatccagtgcagtgcaccggaataaagagaatttgtaggcgtatacagctttaaatgatttattttttatgaaaatgttaactgatgagattatatctacatacgtgtgttatgtgtgtggatatagatgcacacatatctgtacatatacatgtgagtgtacatatatacacatatacacatctatgtatggatatgtgtgtatacacatatacacatctctgtccaaaatttcctcaaagatatggggattttttcatgaatccatgtggatgaatgaggtgtctcctttccatacccagtctcaccttctccccaccctacctcacctcttctcaggcacccctcttccccagctgtcctgccagcccttctcgtacagggtggctcctttgaagtggagtaatagggaaggttgctctctgccacagcttgcagcatggtcttgactgaatgtactgttcctgttagcgttacttctcctgtggtcagtaagttgcccagagagaaggaacaaaggtctggagtttacagaatgtctgtttttaaagtcactttatgcgttttccacttttttcttttttaagaaaaagaagtaccatttttgttttgttttgttttgatttttggtggtggataaataatactaaaaggactctagtggaaaggggggatatcgaagagcagggggttgtgaatttccaggtacttggactttttgtagaagtagagagaagaagatgaagtttgccaggagggcccatattttttcagctgaagggtaaaatctttctttgcagagacagtattttgctgaatactttttataatgtgatgattattaaaaaagcaaaaattttggtcacttccaagctagaaggaggaatcagataccctttaatattttttcctcgctccttctggtatatgcatgtcactgcatgataattgagttttcctttgttttaataaaactgttctcagacattaagctaaactaagagaaaaataactttgttgccaaaaggttgtgctatccagattttttatatgtctgcatgtttaaaaaaaaaaaagcaacaaaagaaaatgcactctaacttatgtgaactgagagaaaaaaatcaggttttaaacaggaaaacctatggggaatgatattttttgaaagacttttgtataaagttgagtacttagaaaaaagacaaaccagatgtaatatattttgtggatgtttttatttcttggatttatagtaccttatactaaggttaaaaaaatatgcttgatattgtgaaaaggtgaaattcttcaccaacatttcatttgctcctttgtcatattgtaatgccaatataatatagttaatgaaaacagcatttttaaaaaccgaaatattgaaatggtgtaatgttgtaccatttgcactgtgagcaaatgctaatacagtaaatatattgtgtttgctgacaatcaaaaaaaaaaaaaaaaaaaa

SEQ ID NO: 146 - DNA, 1837 bp, Homo sapiens
ctcaaactcagctcacttgagagtctcctcccgccagctgtggaaagaactttgcgtctctccagcaatgcatctccttgcgattctgttttgtgctctctggtctgcagtgttggccgagaactcggatgattatgatctcatgtatgtgaatttggacaacgaaatagacaatggactccatcccactgaggaccccacgccgtgcgactgcggtcaggagcactcggaatgggacaagctcttcatcatgctggagaactcgcagatgagagagcgcatgctgctgcaagccacggacgacgtcctgcggggcgagctgcagaggctgcgggaggagctgggccggctcgcggaaagcctggcgaggccgtgcgcgccgggggctcccgcagaggccaggctgaccagtgctctggacgagctgctgcaggcgacccgcgacgcgggccgcaggctggcgcgtatggagggcgcggaggcgcagcgcccagaggaggcggggcgcgccctggccgcggtgctagaggagctgcggcagacgcgagccgacctgcacgcggtgcagggctgggctgcccggagctggctgccggcaggttgtgaaacagctattttattcccaatgcgttccaagaagatttttggaagcgtgcatccagtgagaccaatgaggcttgagtcttttagtgcctgcatttgggtcaaagccacagatgtattaaacaaaaccatcctgttttcctatggcacaaagaggaatccatatgaaatccagctgtatctcagctaccaatccatagtgtttgtggtgggtggagaggagaacaaactggttgctgaagccatggtttccctgggaaggtggacccacctgtgcggcacctggaattcagaggaagggctcacatccttgtgggtaaatggtgaactggcggctaccactgttgagatggccacaggtcacattgttcctgagggaggaatcctgcagattggccaagaaaagaatggctgctgtgtgggtggtggctttgatgaaacattagccttctctgggagactcacaggcttcaatatctgggatagtgttcttagcaatgaagagataagagagaccggaggagcagagtcttgtcacatccgggggaatattgttgggtggggagtcacagagatccagccacatggaggagctcagtatgtttcataaatgttgtgaaactccacttgaagccaaagaaagaaactcacacttaaaacacatgccagttgggaaggtctgaaaactcagtgcataataggaacacttgagactaatgaaagagagagttgagaccaatctttatttgtactggccaaatactgaataaacagttgaaggaaagacattggaaaaagcttttgaggataatgttactagactttatgccatggtgctttcagtttaatgctgtgtctctgtcagataaactctcaaataattaaaaaggactgtattgttgaacagagggacaattgttttacttttctttggttaattttgttttggccagagatgaattttacattggaagaataacaaaataagatttgttgtccattgttcattgttattggtatgtaccttattacaaaaaaaatgatgaaaacatatttatactacaaggtgacttaacaactataaatgtagtttatgtgttataatcgaatgtcacgtttttgagaagatagtcatataagttatattgcaaaagggatttgtattaatttaagactatttttgtaaagctctactgtaaataaaatattttataaaactaaaaaaaaaaaaaaa

SEQ ID NO: 147 - DNA, 1062 bp, Homo sapiens
gctctgttctacagcacactaccagaagacagcagaaatgaaaagcatttactttgtggctgggttatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttc

SEQ ID NO: 148 - DNA, 3003 bp, Homo sapiens
cgaagtcaagacgtctggaaagaattacccagtcctggcttcgagcagcccattgaaccagagacttgaaacagccccagccaaagacttttctcccaattctgcgcttcctgggttctgctgagtcttccacaggctttttttttttttttttttttttaagacgaaaaagagattttctgttatcgggggcagaaagactgaagcacaaaaaaaaaaaaaaagaaaagaaaagaaaagaaaaaagaaaagttaatttatttttaaagcataatttttttaagaattagactgaagtgcaacggaaacataaagagaatattagtgaaattattttttaaagtggggaagaatcaaacatttaagactcccctatcctttttaaatgttgtttttaaatttcttattttttttggccggtcgtctcaaattcatctgatctcttattacctcaattttggaaactgcccgccaccgaccctccgggaccacacagacaggctgaggacgactttatgaccaagagctgaacaagatgcattgtgagaggtttctatgtatcctgagaataattggaaccacactctttggagtctctctcctccttggaatcacagctgcttatattgttggctaccagtttatccaaacggataattactatttctcttttggactgtatggtgcctttttggcatcacacctcatcatccaaagcctgtttgcctttttggagcaccgaaaaatgaaaaaatccctagaaacccccataaagttgaacaaaacagttgccctttgcatcgctgcctatcaagaagatccagactacttaaggaaatgtttgcaatctgtgaaaaggctaacctaccctgggattaaagttgtcatggtcatagatgggaactcagaagatgacctttacatgatggacatcttcagtgaagtcatgggcagagacaaatcagccacttatatctggaagaacaacttccacgaaaagggtcccggtgagacagatgagtcacataaagaaagctcgcaacacgtaacgcaattggtcttgtccaacaaaagtatctgcatcatgcaaaaatggggtggaaaaagagaagtcatgtacacagccttcagagcactgggacgaagtgtggattatgtacaggtttgtgattcagacactatgcttgacccagcctcatctgtggagatggtaaaagttttagaagaagatcccatggttggaggtgttgggggagatgtccagattttaaacaagtacgattcctggatctcattcctcagcagtgtaagatattggatggcttttaatatagaaagggcctgtcagtcttattttgggtgtgttcagtgcattagtggacctctgggaatgtacagaaactccttgttgcatgagtttgtggaagattggtacaatcaagaatttatgggcaaccaatgtagctttggtgatgacaggcatctcacgaaccgggtgctgagcctgggctatgcaacaaaatacacagctcgatctaagtgccttactgaaacacctatagagtatctcagatggctaaaccagcagacccgttggagcaagtcctacttccgagaatggctgtacaatgcaatgtggtttcacaaacatcacttgtggatgacctacgaagcgattatcactggattctttcctttctttctcattgccacagtaatccagctcttctaccggggtaaaatttggaacattctcctcttcttgttaactgtccagctagtaggtctcataaaatcatcttttgccagctgccttagaggaaatatcgtcatggtcttcatgtctctctactcagtgttatacatgtcgagtttacttcccgccaagatgtttgcaattgcaacaataaacaaagctgggtggggcacatcaggaaggaaaaccattgttgttaatttcataggactcattccagtatcagtttggtttacaatcctcctgggtggtgtgattttcaccatttataaggagtctaaaaggccattttcagaatccaaacagacagttctaattgttggaacgttgctctatgcatgctattgggtcatgcttttgacgctgtatgtagttctcatcaataagtgtggcaggcggaagaagggacaacaatatgacatggtgcttgatgtatgatcttccatgttttgacgtttgcagtcacacacaacaccttagttcctctaggggctgtacagtattgtggcatcagataatgccaccaaaggagacatatcactgctgctgggacttgaacaaagacatttatatgggtttattttcattctgccaaagtaaaacaatacatcaacaagaagaaactcagatttaacctgttatttctatgaaaatgggatgaattctttgtttatgcactttttccttactgtgcatccgcctgaaagtgttttggcctatatacctcactagccatgctttatgtgggttatcatggaagaaaaggattttggaaactcaaggaaaagttctttcaacctatacaacctaacttatggactgtttgatagatgataattttttttttttaggaaggattttctttttaactttaccaaatgaaatgccaaaggaagttttaaaggccgtggctgtgctgtatttgatataattgtactgtgtttttaaattgtgtatgccaatcttaaagacaaattttgcatattctctattttacttttctgccaaaataaacctgttcttccttttttaaaataaaataagttcttaaaaaatttatacttaaaaaatcctgcccaaaatgtgaagcttggttgactgatgttcatgatagaaagaataaaatgtttctctctctctaccttttaaaattgaatagtttatttctgtgaaagaagtatttaaactttcaatattttaactttttgtttttatttcttttagaaaaggccaatatacctatcgcg

SEQ ID NO: 149 - DNA, 1567 bp, Homo sapiens
gattcacatccattggtcaggggcaaataccactagctctgcatcctcagtcactttgtgccatttcatcaggtcagagccaaaggaaagcttgaaaaatgaagacattagcaggacttgttctgggacttgtcatcttggatgctgctgtgactgccccaactctagagtccatcaactatgactcagaaacctatgatgccaccttagaagacctggataatttgtacaactatgaaaacatacctgttgataaagttgagattgaaatagccacagtaatgccttcagggaacagagagctcctcactccacccccacagcctgagaaggcccaggaagaggaagaggaggaggaatctactcccaggctgattgatggctcttctccccaggagcctgaattcacaggggttctggggccacacacaaatgaagactttccaacctgtctttggtgtacttgtataagtaccaccgtgtactgtgatgaccatgaacttgatgctattcctccgctgccaaagaacaccgcttatttctattcccgctttaacagaattaaaaagatcaacaaaaatgactttgcaagcctaagtgatttaaaaaggattgatctgacatcaaatttaatatctgagattgatgaagatgcattccgaaaactgcctcaacttcgagagcttgtcctgcgtgacaacaaaataaggcagctcccagaattgccaaccacttcgacatttattgatattagcaacaatagacttggaaggaaagggataaagcaagaagcatttaaagacatgtatgatctccatcatctgtacctcactgataacaacttggaccacatccctctgccactcccagaaaatctacgagcccttcacctccagaataacaacattctggaaatgcacgaagatacgttctgcaatggtaaaaatttgacttatattcgtaaggcactagaggacattcgattggatggaaaccctattaatctcagcaaaactccacaagcatacatgtgtctacctcgtctgcctgttgggagccttgtctaatttcagataatggttagcattacgatggctactataaataaaccattcttactgctctcttccaaaacaaaactcagcatgatactttgagattgtgttctgagagatgatatgactacataaaatacaattaaaaatgttataatataatgaaaatgtagtaatttaagaaaacaccagatgagttaggaataaacctataacatttacaaaaagagcaaaactaagtgatagaaaatatttcacacatgttcttatagatcatgtatcacttgcaagttttaggagttcatatcctatatcatttcaaattaagtacataataaagtaaaattttgaaatgaacactttaggtatttttgccaagatttagatgtttttaattaaacttttctcttcctttttttttcactaaggcatgtttattcccctaatccattaaagagcatgaaaaaaagaataaatgtatttgaaaaaaaaaaaaaaaaaaaaaaaaaaaa

SEQ ID NO: 150 - DNA, 2490 bp, Homo sapiens
accagttcgcgccggcggtagacgaggacgccaacagcagcggagaaacgtttctctttcctctcagtttgcgcacaccatggcggcccctgcccagcagactactcagcctggcggcgggaagcgcaaaggcaaggctcagtatgtgctggccaagcgcgctcggcgctgcgacgctggcgggccccgtcagctagagcccgggctacagggcatcctcatcacctgcaatatgaacgagcgcaagtgcgtggaggaggcctacagcctcctcaacgaatacggcgacgacatgtatgggccagaaaagtttacagacaaggatcagcggccctctggaagtgagggagaggatgatgatgcggaggctgccttgaagaaagaagttggtgacattaaggcatctacagagatgaggttaagaagattccagtcagtggaaagtggagcaaataacgttgtcttcatcaggacacttgggatagagcctgagaaattggtgcatcatattctccaggatatgtacaaaaccaagaaaaagaagactcgagttattttgcgaatgttacccatctcaggcacatgcaaggcttttttagaagatatgaaaaaatatgcagaaacatttttggaaccctggtttaaagctccaaacaaagggacatttcagattgtgtacaaatctcgaaataacagtcatgtgaatagagaagaagttatcagagaattggcaggaatagtgtgcaccctcaattcagaaaataaagtggatctcaccaatccacagtacacagtggtagtagaaatcatcaaagctgtctgttgcctgagtgttgtgaaagattacatgttgtttagaaaatacaatctccaggaggtggtgaagagccctaaggatccgtcacagcttaactcaaagcagggaaatggggaagaagctaaactggaatctgcggacaaatcagaccaaaacaacacagcagaaggaaaaaataaccagcaggtaccagagaatactgaggagctggggcagacaaaaccaacgtctaatccacaggtggtaaatgagggaggagccaaacctgaacttgcaagtcaagccacagaaggatccaagtcaaatgaaaatgactcctcataggaagtcatttggtgttggaggtgggtttctcacctggggctctacgagatgttgctggggctccaccttaaattgtgactaaaaacagttttttatttgtgtgctgcactatgctgttctcacagtagtgagcaatgattgcgcagccctgttaacagtttttttagggatctttcagcctttatggtattacgtagaggcagacccatgtgctgctgttgcaaagaggggaggataggagggggatgttggcctctcccaggctcctcttctgcagtgccagctgacttaagggagtgaactacctgtgaagtagaaaatcagagggaagttttcattctaaggaaggagtttttacatgccacagctcagctgtctgcctgccactttgttgtaaacattgcaaaaatgtggatcatgtaggttagaagtgaattgtttagtgaagtttttgtacttttgtgattttcttgtttatgtctgtttttttttttttttttaacatttgtgtgtaatatagctgacagtccagtgtcgcaattttggaaggcaagatgtgagagagacgagaaccattttaggcatagaactacagacatttctgaaaaggttggtgatgaagaacttcagtcttctgagtatacttcagtatactagtgcaacaagggacacaaagaaattctgtcttaataaagaaagctacttctcaagggtattatgtggactcagtccaagctctcctgtcccattgtgcattgtctgtgacatgcaacttacaaaactagcaattgtaacaataaatcacagccacttgacaagaaaggatattcattattttcaaatggcttttggactatcaaaaacagtaaggcttttgttcagaaatcacctttagtcaaaaggtttaagaagcaaattatttagtagcagaacttatctcaggaaaggaaaatatgcatggttggtgagaatctaataacattaaaatgctggggcaagatgcagtacaagttgaagagactttattctcaataagttgatttactgatgatatgtcatatgatgcaaaaaaggttttgtgtcattaactgaaaagtagcagcttctctatccaggatgatgagtcaacaggtttcactaatatttgtcatgctgtagcatttgtaagatttgtaaatgatgaaattcaaagaaaactttttctattgctaggagcctgccagaacaaggccaatatataatgttgtgacatcatatctgataaccagaggtctggtatctacactcctggtgccccatcagtggttgtctccataagtcattttgcgttaaaaaaaaaaaaaaaaaaa

SEQ ID NO: 151 - DNA, 1719 bp, Homo sapiens
ccgaattcgggggcagcagccacattggcagtgaggccgtggcagcgtcagcagcagaggatgccccaggccctggagcgtgcagatggcagctgggcctgggtggtgctgctggccaccatggtgacccagggcctcaccctgggcttccccacgtgtatcggcatcttcttcactgaactgcaatgggagttccaggccagcaacagcgagacctcttggttcccctccatcctcacggctgtgctccacatggcagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgttaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacacaggctactgcgtgtacatactgggtgtgatgtggtccgtcctgggcttcccactgccacaagtcttcctggtgccatatgccatgtggcacagcgtggacgagcagcaggcagccctcctcatctccatcatcggcttcagcaacatcttcctgaggcccctagccgggctgatggcaggacggccggcctttgctagccaccgcaagtacctgttcagcctggcactcctgctcaatgggctcactaacctggtgtgtgcggcatcaggtgacttctgggtgctcgtgggctactgcctggcgtacagcgtgtccatgagtggcatcggcgccctcatcttccaggttctcatggacatcgtccccatggatcagttccccagagccctgggactcttcactgtcctggacggccttgctttcctcatctccccaccactggccgggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcatgtgccagtcttcccgccagccacgtccagctggcgtcaataagcatctttggggatgtcctgcctcctccaggaccagccatgagtggctcttatggccaaaggcggtactgcaggccaagcaaacggctctgggctggaatagccctacctgagtgccctgtttgactccgccactatctgccatgtgagttgggcaaattgttgaccacctctgagccttgaaaaagtaggaggttactttgttagagcaaaataataaaatttaattttaaaaaagaaaaaaaaaaaaaaaa

SEQ ID NO: 152 - DNA, 1123 bp, Homo sapiens
ccgagggccattgagtggcgatggcggcgacggcgagtgccggggccggcgggatggacgggaagccccgtacctcccctaagtccgtcaagttcctgtttgggggcctggccgggatgggagctacagtttttgtccagcccctggacctggtgaagaaccggatgcagttgagcggggaaggggccaagactcgagagtacaaaaccagcttccatgccctcaccagtatcctgaaggcagaaggcctgaggggcatttacactgggctgtcggctggcctgctgcgtcaggccacctacaccactacccgccttggcatctataccgtgctgtttgagcgcctgactggggctgatggtactccccctggctttctgctgaaggctgtgattggcatgaccgcaggtgccactggtgcctttgtgggaacaccagccgaagtggctcttatccgcatgactgccgatggccggcttccagctgaccagcgccgtggctacaaaaatgtgtttaacgccctgattcgaatcacccgggaagagggtgtcctcacactgtggcggggctgcatccctaccatggctcgggccgtcgtcgtcaatgctgcccagctcgcctcctactcccaatccaagcagttcttactggactcaggctacttctctgacaacatcctgtgccacttctgtgccagcatgatcagcggtcttgtcaccactgctgcctccatgcctgtggacattgccaagacccgaatccagaacatgcggatgattgatgggaagccggaatacaagaacgggctggacgtgctgttcaaagttgtccgctacgagggcttcttcagcctgtggaagggcttcacgccgtactatgcccgcctgggcccccacaccgtcctcaccttcatcttcttggagcagatgaacaaggcctacaagcgtctcttcctcagtggctgaagcgtttcagggcacacaggacagcagaagatcccctttgtcagtggggaaaccaaggcagagctgaggggacagggaggagcagaagccatcaagatggtcaaagggcctgcagagggagatgtggccttcctccccctcattgaggactcaataaa

SEQ ID NO: 153 - DNA, 1375 bp, Homo sapiens
tcgaattccggaagccgctcccgacaccctttgcctggctctgtccatattagttcccaggcggccgtcgcgttccagcagcggcacgcagcgcaggcggagcggcagcggggcctcggctctatagagccgagccgctggtacccgcccggtaccgcgcgagccagtgcccctggatcttgcctctgctccgacgccgttccccaccagttagcgacagcgcccgcccctctgaggagacacgaaggtggttccccagccgctcaaatttccggaccaccgcgctttcccctcctcagcctgggctgtgctctctctagaatcctcgggcccccactttcttcccaaactcatcctaaatctctcacacacgcgagtgttcccagccctcaagccagctgctcctcctccgttcattttctgcccctcttcgcaaagcacccccgggatcatcctccgagggcgactttttgagaaatctcggtggagtagtggaccagagcaggggagtttttaaaagccggggcgcgagaaacaggaaggtactatggcttcctcgtctggcaacgatgatgatctcactatccccagagctgctatcaataaaatgatcaaagagactcttcctaatgtccgggtggccaacgatgctcgagagctggtggtgaactgctgcactgaattcattcaccttatatcttctgaagccaatgagatttgtaacaaatcggaaaagaagaccatctcaccagagcatgtcatacaagcactagaaagtttgggatttggctcttacatcagtgaagtaaaagaagtcttgcaagagtgtaaaacagtagcattaaaaagaagaaaggccagttctcgtttggaaaaccttggcattcctgaagaagagttattgagacagcaacaagaattatttgcaaaagctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagagatgtctgctataagtttcatctgttgtgtgctatacatgtaaaaactgtctctttgaactattgaaaatttaaggttcagtataatatcaattttgaatttttcctggtgtttatgaaattttagatagcagcaagtcttcgtttgatcataaacagtgtacagataactcaa

SEQ ID NO: 154 - DNA, 2169 bp, Homo sapiens
ccgcggctccccgactcctttcccagaggtgagtgcccgaagccaggagcccggggcgcctaggtctgtgcgctgcggggaacccctaccgccagcctccccgccacccgcgcgcccccaagcccagcgggcgaggccccgggcgccccacagccggcgccgcgccatgctccaccttagcgagttttccgaacccgacgcgctcctcgtcaagtccactgaaggctgttgcgccgaacccagcgctgaattgccccggctgcctgccagggacgctcccgcggccaccggctaccctggagcaggcgacttcttgagctgggctttgaacagctgcggcgcaagtggggacttagccgactcctgcttcctggaggggcctgcgcccacaccccctcccggcctcagctacagcggtagcttcttcattcaggcagtgcccgaacacccgcacgacccggaggcactcttcaacctcatgtcgggcgtcttaggcctggcacccttccccggtccagaggcagcagcgtccagatccccgctggatgccccttttcctgcggggtccgatgccttgctgccgggtccgccggacctttactccccggatctgggcgctgcccctttcccagaggcgttctgggaggcctcgccttgcgcgggtgccccctcgcagtgcctgtatgagcctcagctctccccgcccgacgtcaagcccggcctccggcggcctcccgcctcgccagcgctggacgctgtctctgccttcaagggtccctacgcgccctgggagctgctttctgtgggggccccagggaactgtgggtcacagggagactaccaggccgccccggaggctcgttttcccgtaatagggaccaagattgaggacttgctgtccatcagctgccctgcggaactgccggccgtcccagccaacagactctatcccagcggggcctatgacgctttcccgctggccccgggtgacttaggggagggggctgagggcctccctgggctcctgacccctcctagtggggagggagggagtagcggcgacggcggagagtttctggccagtacgcagcctcagctttccccgctgggccttcgcagcgccgccgcggcggacttccctaaacctctggtggcggacatccctggaagcagtggcgtggctgcaccacccgtgccgccgccgccgcccacccctttcccccaggccaaggcgcgacgcaaggggcgccgcggcggcaaatgcagcacgcgctgcttctgcccgcggccgcacgccaaggccttcgcttgcccggtggagagttgtgtgcggagctttgcgcgctccgacgagctcaatcgccacctgcgcatccacacgggccacaaacccttccagtgccgcatctgcctccgcaacttcagccgcagcgaccacctcaccacgcacgtgcgcacccacaccggcgagaagccttttgcttgcgacgtgtgcggccgccgcttcgcgcgcagcgatgagaagaaacggcacagcaaggtgcacctcaagcagaaggcgcgcgccgaggagcggctcaagggcctcggcttttactcgctgggcctctccttcgcttctctctgagcaagagatgggtttatgggttggggcgccgccgttcggcgcgcacgagttccgggccgttcccctccccgctcttcttccaactcctcctcgcacgcccgagggccggcctccgtcccgcttccagtttccttgaagcgcccgccgcacacgccctattcagcaccagctcgccggacagttcccgcggtccaggcgctgtcacccttgtcagccgcgctttgggggaagtcttctgagaccacccagtgaataggcactaccctgggattcaagacagtcttttgtaactgcacacgccccacgccttcctctataacccccagagacaggctggggcaggccaaggcggtctcgcgcgggactttgtacagcagtgtcttatccagcagccgattggatgtaacgttttgctttgggttttttttccttttgttgttgttaatttttgtaaagcagacgctactctcaagcagttgacaaaactgtttatttttgcaattaaaattattgtgctaaaaaaaaaaaaaaaaaaaaaaaaa

SEQ ID NO: 155 - DNA, 2186 bp, Homo sapiens
acacggaccaaggagtctaacacgtgcgcgagtcgggggctcgcacgaaagccgccgtggcgcaatgaaggtgaaggccggcgcgctcgccggccgaggtgggatcccgaggcctctccagtccgccgagggcgcaccaccggcccgtctcgcccgccgcgccggggaggtggagcacgagcgcacgtgttaggacccgaaagatggtgaactatgcctgggcagggcgaagccagaggaaactctggtggaggtccgtagcggtcctgacgtgcaaatcggtcgtccgacctgggtataggggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataatgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttgggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagttgtttgcaattaaaacaaggtttgcccacaaaaaaaaaa

SEQ ID NO: 156 - DNA, 8992 bp, Homo sapiens; identical to SEQ ID NO: 10

SEQ ID NO: 157 - DNA, 667 bp, Homo sapiens; identical to SEQ ID NO: 11

SEQ ID NO: 158 - DNA, 5316 bp, Homo sapiens; identical to SEQ ID NO: 12

SEQ ID NO: 159 - DNA, 972 bp, Homo sapiens; identical to SEQ ID NO: 13
  modified_base (603)..(603): a, c, g, or t

SEQ ID NO: 160 - DNA, 2716 bp, Homo sapiens; identical to SEQ ID NO: 14

SEQ ID NO: 161 - DNA, 3508 bp, Homo sapiens; identical to SEQ ID NO: 15
  modified_base (2673)..(2673): a, c, g, or t
  modified_base (2688)..(2688): a, c, g, or t
  modified_base (2695)..(2695): a, c, g, or t
  modified_base (2705)..(2705): a, c, g, or t
  modified_base (2708)..(2708): a, c, g, or t
  modified_base (2716)..(2716): a, c, g, or t
  modified_base (2724)..(2725): a, c, g, or t
  modified_base (2728)..(2728): a, c, g, or t
  modified_base (2757)..(2757): a, c, g, or t
  modified_base (2759)..(2759): a, c, g, or t
  modified_base (2763)..(2763): a, c, g, or t
  modified_base (2772)..(2772): a, c, g, or t
  modified_base (2784)..(2784): a, c, g, or t
  modified_base (2788)..(2788): a, c, g, or t
  modified_base (2794)..(2794): a, c, g, or t
  modified_base (2801)..(2801): a, c, g, or t
  modified_base (2805)..(2805): a, c, g, or t
  modified_base (2818)..(2818): a, c, g, or t
  modified_base (2828)..(2828): a, c, g, or t
  modified_base (2840)..(2840): a, c, g, or t
  modified_base (2861)..(2861): a, c, g, or t
  modified_base (2864)..(2865): a, c, g, or t
  modified_base (2934)..(2934): a, c, g, or t

SEQ ID NO: 162 - DNA, 1449 bp, Homo sapiens; identical to SEQ ID NO: 16

SEQ ID NO: 163 - DNA, 5605 bp, Homo sapiens; identical to SEQ ID NO: 17
  modified_base (2235)..(2235): a, c, g, or t
  modified_base (2659)..(2659): a, c, g, or t
  modified_base (2667)..(2667): a, c, g, or t
  modified_base (3334)..(3334): a, c, g, or t
  modified_base (5256)..(5256): a, c, g, or t

SEQ ID NO: 164 - DNA, 1781 bp, Homo sapiens; identical to SEQ ID NO: 18

SEQ ID NO: 165 - DNA, 1890 bp, Homo sapiens; identical to SEQ ID NO: 19

SEQ ID NO: 166 - DNA, 1056 bp, Homo sapiens; identical to SEQ ID NO: 20

SEQ ID NO: 167 - DNA, 623 bp, Homo sapiens; identical to SEQ ID NO: 21

SEQ ID NO: 168 - DNA, 3727 bp, Homo sapiens; identical to SEQ ID NO: 22

SEQ ID NO: 169 - DNA, 2087 bp, Homo sapiens; identical to SEQ ID NO: 23

SEQ ID NO: 170 - DNA, 665 bp, Homo sapiens; identical to SEQ ID NO: 24

SEQ ID NO: 171 - DNA, 1987 bp, Homo sapiens; identical to SEQ ID NO: 25

SEQ ID NO: 172 - DNA, 1374 bp, Homo sapiens; identical to SEQ ID NO: 26

SEQ ID NO: 173 - DNA, 2513 bp, Homo sapiens; identical to SEQ ID NO: 27

SEQ ID NO: 174 - DNA, 1737 bp, Homo sapiens; identical to SEQ ID NO: 28

SEQ ID NO: 175 - DNA, 629 bp, Homo sapiens; identical to SEQ ID NO: 29

SEQ ID NO: 176 - DNA, 3113 bp, Homo sapiens; identical to SEQ ID NO: 30

SEQ ID NO: 177 - DNA, 5190 bp, Homo sapiens; identical to SEQ ID NO: 31

SEQ ID NO: 178 - DNA, 2657 bp, Homo sapiens; identical to SEQ ID NO: 32

SEQ ID NO: 179 - DNA, 9295 bp, Homo sapiens
  modified_base (176)..(179): a, c, g, or t
  modified_base (181)..(187): a, c, g, or t
  modified_base (216)..(216): a, c, g, or t
  modified_base (942)..(942): a, c, g, or t
  modified_base (947)..(948): a, c, g, or t
  modified_base (1604)..(1604): a, c, g, or t
  modified_base (2275)..(2275): a, c, g, or t
  modified_base (2574)..(2574): a, c, g, or t
  modified_base (3132)..(3132): a, c, g, or t
  modified_base (4279)..(4280): a, c, g, or t
  modified_base (5306)..(5306): a, c, g, or t
  modified_base (5984)..(5984): a, c, g, or t
  modified_base (6071)..(6071): a, c, g, or t
  modified_base (7021)..(7022): a, c, g, or t
  modified_base (7025)..(7026): a, c, g, or t
  modified_base (7028)..(7029): a, c, g, or t
  modified_base (7747)..(7747): a, c, g, or t
  modified_base (8449)..(8449): a, c, g, or t
  modified_base (8453)..(8453): a, c, g, or t
  modified_base (8518)..(8518): a, c, g, or t
  modified_base (8544)..(8544): a, c, g, or t
  modified_base (8602)..(8602): a, c, g, or t
  modified_base (8611)..(8611): a, c, g, or t
taaccgatcgatcccgaagaccaccttgcgagggccccccccgcccggttctggatgatgtccttgacgatgcccttgatgtacctgccgctcacgaaatccacggcgcgcagcgccagccctttacggtgcttcacgtgcgccggaacacagacccggccccttcctctgtccannnntnnnnnnnttttttttttttttttttttttttttttntcattttagaatgttctttattctgacagttgttggacaaatataaggcatgttcacaagtatctgaagttatgtacaaaacacactcattcaacggatgttcctcttctccttttgtacttgctgctgcaaactgatcctcatgcacgttaacacccatagcgctcaattcttatggatatgcagacagtgttttggggaccaccgtggagaatctgtttcaaactaaggcgtgagcttctaagaactaagtcactaagacatcagaactcacagtgaacaaaggcagaggaaggtgaccaaatcagctcataaactcatgactctaagtttccagtggaacaaagaacacattgaaaaacattttttgatccttcatgttggagagaaatggaatgtgaccagaattcatggttctatatttaccactgtctaaaagtcacaaaacaatatctaattttttcatggtttctaatgcagttacagttttgttcttaggtcacagtacaagactgcatgcatactttacacaaatatcaaacacagaacgattgtaacacagatacctcagggttgtctaaagacacagcttctctttttgtggtggggtggggaaggagaatggtggtggccatttccacacacagcctgttgtgtgctcagcacggctggatgcggatcccaagcactcgctgactgactcacagaagaggacagaagctgctnagganngcagcggagttcaaagagcaggctccaaccgggggctgggatgacggacacacagcctcgattccagggggaaaaagtcttagtcgatactaattaaaaagtgttaatgatttttgaaaatcagattacatctataaaagatgaaaagcaaacacttaaaacaatctaacgggggaacataaaataataaaaaatcaaatgcagatgggatttcacaaagaggagatttgaatcttttggtctaaatcagccaatattttaacattaactataaattattaaaatatagtttgcttatgcccatccttaaaatgcagaatctttgaggaaaaatataggcatatcaggaatacagactcttgtaaaaaatttaaaaagtcagtatcatctctcttgtggagctaccagaacaggtttttcaaacagaaaaggggaacaaacgtggggaacaaacgtggggcgcttggctatgttaagaattcttatcactagaatactgcttcgagacgttcatagtactttccaaaagaagccacccacctcaaagagccctgcgcagccccagtgacccatgagtgtggtagccgtcattttattagccactgttggcaatcatcaaagtattcactcagagtggggaaattacttaatatcancgatattaacgatttccatgtatttagctttgtgacacacaatgcacaagggtcttcaaatgtttgttttttacaccagtggtagaaaattgtcattcttcggattcaacacactggtggatgacactttagtgaagtgtgactacctagaagagcaggaaggcagctcctgattctgactgggccagcctcttccagaaggtgactcttctgtcaggagatcacgaccctggcaggccgggcaagcgctctgccctttaagccactgcttaaagcaccctttgtgatacttgtgcccacatttgagcacacgcacgttttttgatttgaacacctcgtggcatatttcacaggaacttgcacccagtgcaatcctcacagggacatcttctgctttctgccccttggttttgggtgatggtgcaacaaccaccgagggtgagccctgggaggacctggtcacgggggtggcagagctgggctcataagtcctcttgtcctttcctgggtttggctttttctttttctgttcatctagaatgtgttctgtcactctttggacaatttcatcaatactcaatcctgagagtgagttcttgtttttgcttcgcacttttttaataaaaccagcaagctcagtgctgttgtaacatgggaataccactgacagntgctcaataatactattgaacggcttttttggagactggcttgaacgcgcagcacgtcctggaggaacaggctgcttccgatcagccacagggcttcgttctgacagagctgcctggccagcccgttttggccctgtcagctgagtggcttcaggctgaccagggggtggccctggcaacagcgcagaaggagcctcccctggggaatcaccagcagagaacacactaggatccctgtgaagtgctgcgtggtttccagtcacgtcgcttgcagaagtcacaagcccttggccatcgtngcctgaagactcagggagtaactcgggatgaaccgtgttacaggcaggaaatgaaagctcagaaatctgcactttagaaagttcactgagccgagaaccatttttaattgccttaatttgttcttcaaactgagactttgctttctcaatttcttttgtaacattagaaagaaacaattcccatgaacgtatatcagactccatgtcaggatatgctgcaggatcacggctaatcagccccagcttcttcagaaaggcttctgcttgtgactccatgatctgtagcttatacacttcactctccttccagttttcaagtacggatacctctgcagccacagctctctgatgactctcttcataatcctctttccctttctttatatactcttctattttcattttctcatttgtaagtgtgttgctgatttcaagggactgatccagatgtaattcatgttccttttcctttccatcatttttctgggtatacatttcactggcatttgaaacctttttaattttcttcttcagtgattttagtctttcttggatttnttttttttcctgttgccattttttaatttctctttccaaatcttgaaggaaccaatctaattccgtctttgagatcttgttttcttctaagtgccttttcaacttctcttccaggtccctggtctcttctaagcccttaagttttatctgctcataattttcatacacttcttgaagttggtcttgtaatacttggtgctccttttcaatccgtgaaatttccccttgtcgttcctcaaaaggattatatggctcagtattgacttcttggtgtattatgttccaagatacctgtatggcaaccatctgcacgtgtggaatgtttgttactgcactggtgctttctggaattacttcacatttgttgttagaatttccacagtgctcatcatttctgttagactcactcaggactgtatgagcatcacctgtgctgcagtgtgactttacagatattcccaaagagccctcaaggatctgtgtttcagaggcaatctggtgaccagcaacattctcagcattcaaatgatgaccctcaaaataggcagcagcatttttatctgctctgtcattggctacaaaagacggcaccactggtactgatcttggtagctgatattcaggagaaaggctggccaagggtgtatatatgctggtgtactggggcaaacctggtaacacgtttatgtatgctggcggtgtctgggtgatatcaaatctctggaaaggaagatacgtacagtatcctgtgaccaaatgggattgagcccaataagttggtttcacatcctcaagaaccggtttgggggaattacaggagactcgcttgtaatttgcatcctcagagcctggtttaggagaattagaagagacccctttgggttgcccatcctcagaaacttgtctagaagaattgtcggatactggtttggccttcacatcttcacaagctggcttgggagaatttgcagacacaggtttgggtttcacattttcaaaagctggtgctgaagatgaatctgacactggtttagactttacatctggtttaaattccctagcagctggattcagttgtagtttaactcgtacatactcccctgcttttgaaatttcttctacttttgttttaatgtttttcttcttnntttttttcttgagccgtgatgcaaccttcttcagtgcaatacagttgtcaatcacaacaaaacgagggcatcccaagagaaaaggttttaaacctcctgctttttctagtatctgtcgagtttcttctgggaaaaactcatattctgcagagaacatcttgttactcatgtccaagggaccatgttcctccaaaaactgagagaagtaatcatatagagttgaacatttttgttttgggttcatgtcccatagcttcttattgcggacaacatattcgttactgtgttggtcatagagagcttcgaattcttctacatcttgccgaagatggtcaggcactgcaaatgggcctgcagaatctgaatttcgattgctatggtcttcacttgaagtgatgatctcattatttgaagttactgaagttgttccagacccaactaacataggctttgaatcctttggcttctttttcttgcttttgtttttcaccttggttgaactaaacggtgcttcaccactatcttgtttccttaacacagtacagcggctgtccattatatcaaagaattcatctaaagcactatgcaatgctgggaacttgtctctgtgttcttctagcagccatattaaacaacgggcttccttcaatgatgctggctcagagaaataatcaagttgctttccttctatagagtctagtttgtgaccatatttctcattccagaggaaagtcatgatactaaaatcaagcagtttaagagatgctccataacgagaaaagaaagttcctgtggcatctaagccaaagctattaagtttttggatccaggcggctaatttgggctccacttctttaagctcactcaaaacatgcagaaatattcttgtctttactctgttattttcttgaatcaagtggcgaataacatagtccactgcttcatttagaaaatttctgctagaaaaacaggttgtatagtcttctgtgctcaaaactttccaagaaagcaattctttgagaagcntggctgtattctgtatgccggatttaatcttgtcagcatactgctttatacactgtagaattctgtcatcaaggaactgacaacgctgaacattgtctacagtttctttctgctcttcatttttgggtggattactttctcttaagtcctcctccattctttcttgtgctaacttttttgcttcttttttttggatctttctcttcaattttttgtcttctttcagtcttagtttctctaggctagaacatttctgtttcagaataggtcttggaggaaccttttcttttatgaccttgtgttcaaattcacatttaacttcaccaccactgctgaagatgataatcttagaaatgacaccttcacagtcaggggtaagacatattccttgtagaaaatccttgtcaattttatcattaaaggttgtagtttttaacttcttccagcaattcatgtgaaattctattttacagtactggcaacagctgatgcgtataaaacccttaaagtctggatcagttatgtatatctggatcttagaatatccatggcacttctgatagcaacaaatggcatctggcactggagggaacttgcattcttcaacaaatttctctaacagcatctttattttttgtggctgagactcttcaataatcacattactcgtgggccaangttaacactccaggaagacgataaatcaaggttcttgctttctcaaagtgattgagagcttctagaaatctgttttttttcaaatanacttttccaattccacagtaggccaagcaatcaaggccctcactggggtagtgttcaataatcctcttaaactggttttcggcttcagataattcctcaggctgtcctattccaaggagagaaatggcaagtccatagacgaccaaaacatagttaatcatggccaggttcaattgctttattttttgaggatctaaaccgttcagcaactctgtaaaggcctgtgcagcgctgcggcaacgctgctccaataaggccatatagccatcttgaattaagcttctcagcattttcattatattagcaaaatcctggtgtgcagctctggaagatttagaaaactgtttctccaagatgttcttcaaatctgctggtaaagtcaatggtgaactagaactgaacttttctgattcattgtttcgagatttttgttttcctttatgttttggaggctgacttgatggtggtgaaaattcaggatgacagtcacaatcatctaccttcaacgcctcatccgccacctttagattctgattaccaccgttggccatttcgtgattaatttttctgaaatctctttccttctccacaaagttaagtgaagtagtaaatataggtgctgataaactcctaggtgtgtaggccctgttttcataaaaggctttaattggatccttatttgctgttcgaccttgtaggtcttctatttgtttttgtaactttacatgctgctgaattagatccttgattccctcagggtcatttttacagagtttttgagcttttatgtttgcttgcagggcccagtcatattcccccagcatagaaagagcatcacaataacgataatgaccctttggccaagtgttcttcagaatagtggctctctttccatcaccgagtgcatttctaaactgtccagtacgaagaaaacaaagagctcggttacnntanngnnggtagttttcaggtctatattcaatggctctggtgtaatagataatagctatatcaaatctttctttggaaaactcttcatttcctttcattttcattagttctccttcctctatacaatccatacaactttgagttttaagttcttcaagcaaattgcagtcttccattacaattttagttatgtggtacttgtattcagtaaagaaaatacttaacataggccaacaattgtcaattgatcctaatttagttagaattgttacatcgcctgcatattttatccaattcagagcttcttccattgccaagattttattttctattttacaaccaattctcaataagcctccaataaggaatgaatcattagcaactttctttgccaaatccacaatatcttccatcaactcaagatgttgtagtttcttcaaatttatctcagaagcacgtgaattgttggcgtccacacagggatgcaatcgtgatattacggaactgttttgatgttgaaacagaagtggccagaagatgtttattttaatggcatcgcaataatcttgcaggacagaaattggtttactacaccatatactgcagatgtcaaattccaaattcctctcactttggatataatctttatattgcacacccaccccatcacagtaaagctgagtcacacgaacataatcattgctcataaattcagcagcaaaganacaatcatccacgtgagggcaatcttctaacaaggcataatccgccacagtgaaatctccctcagcaaaattgtccatggtgcacaagtctaaggagacaacacaaactcaagtcagtaattaaatcatttgagataacagaagaaagttttcctggcttctatggtatattagaaaaatacttggaacctatgcccaaggaaataactcctatcagaacactgagctccgaaagattctcgtccccattctgctgacttttcctctctctccagataatttaatctatttcttcctttcctcaggttcacatattcaccatctctactctaagttaacctgtttacatgtctcctttaaatagaggatcatcaagggcatcttatttatctttgtatgtgcctagcacatggtaagctctcaaataagtgtttgctgaatgaagaaaagacatcttcctgttgctgcacttgtaccctacctgcttttactgcattctgtgaaatatgccatttcatcatacacaaactgttatattctcaatctcctggcctaacctaaatcctgactccactgagaactttcctatcaactgctcatattctcctatccatctcagtgtgtttctgtcttgggcaaaggagtagggctagagtggtacagggtaagtctgccaatctcctaactccccaaggcggcatncagnccttccatcctcctatcgactgctgcttctaatgctctcacaactactgcaatacacaatcagcnctgctaaatcgcaaaaaggaaaaaanccctcacattatcaaaagccatgttttaaaaatacgtatttcaatggggggcaagggngattggtgntaaagtttcagactaagggtttttttttcctgaagaatcttcaataataaggatttttatagttatcagagaatagctacataggccaaacatcactgaaaaatgcaccattttattacttctagctcttgcccatataatggctttcttttcctatcatcaccagcgcatcataaacactattacttgtacctatcacttcaccattattatcctactattattaggataaaccaagtttcttctttccaaagcaagaacactaccagtccttgaagttcaaatctatttatttaatcaatccatctcatgatgtccaatttgctgtatgaaaacttcacaatatcacaagtgaagaataataacaatcttcctagcaaactatttgtactatgtgtcacatactgtaccaaatgttttacatgcattatttcactaatcttcacagcaattcttcttagcaggcacaattatcgttatctccactgtacagatgggaaaatgctcacttaaatcaagtaatttgctcatgtcaccaagctaggaaggattcaaatccagtctttagttgccatagcttctgctctcaaacactctcttttactacatctaattttcctgtcattgtcacctatttatctcttggttactgtcacgtttcaagatcactggcaactagttcag

SEQ ID NO: 180 - DNA, 2206 bp, Homo sapiens
  modified_base (1)..(1): a, c, g, or t
  modified_base (16)..(16): a, c, g, or t
  modified_base (1240)..(1240): a, c, g, or t
  modified_base (1826)..(1826): a, c, g, or t
  modified_base (1876)..(1876): a, c, g, or t
  modified_base (1879)..(1879): a, c, g, or t
  modified_base (1903)..(1903): a, c, g, or t
  modified_base (2178)..(2182): a, c, g, or t
nagagtcggattcgcngccgcagcagccgccgcccccgggagccgccgggaccctcgcgtcgtcgccgccgccgccgcccagatccccgcaccatgccgtcggagaagaccttcaagcagcgccgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaagatgaagatggattcctgtacatggtctatgcctcccaggagacgttcgggatgaaattgtcagtgtaaaaccagaaaaaatgcatctcttctagaattgtttaaacccttaccaaggaaaaaaaaggggtgttaccaactgagatcgatcagttcatccaatcacagatcatgaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcattctaagttgccaataaaatagaccttcaagttattttaatgctcttttctcactaataggaacttgtaattccagcagtaatttaaaggctttcagagagaccctgagtcttctcttcaggttcacagaacccgccgcctttttgggtagaagttttctactcagctagagagatctccctaagaggatctttaggcctgagttgtgaagcgcaacccccgcaaaacgcatttgccatcacagttggcacaaacgcagggtaaacgggctgtgtgagaaaacggccctggactgtaaactgctgaaggtccctgactcctaagagaaccacacccaaagtcctcactcttgcaggggtagacatttctggtttgggtttgttctctagatagttacacacataaagacaccactcaaaaggaaacttgaataatttataattttgatcgagtttcttaaaagaccctggagaaagagtggcatttcttctgtttcaggtttngtctgagttcaaactagtgcctgtgttgttacggaaagcagcagtgtaccagtgtcactctggagtacagcgggagaaacacaaaatagtataactgaaaacattaacattccagacacactcccttctgccttccggcttaaagctgtggatgatccacgtttttgtttttttaatgttaaatgtgtaactcagtattactgaaaaggtacccacattttgaatagtagttatcactcttaggtcagacagccatcagaattctcccacaccaagtgcatgtcagttgtggagaaaacatagcaaaaagagccgtacgctctttacagatactaatgtcaagagttaaacctcctcaggttcaacctgtgataaaagactagtgcttcccagtacttgcatggggttcactatttatagttttcttgggagtatcacaggaaaatcacaattacaccactttagaccctatgtgtagcaggtcacaacttacccttgtgtgtttagatgtgtatgaaatacctgtatacgttagtgaaagctgtttactgttaacgggggaaaaccagattctttgcatctgggngccctctactgattgttaaaggagttcctgttcacctgctccccccaccnccncgcatgcgtcctgtccacttggcntaacttttaatatgtgtattttttacattatgtatattcttaactggactgtctcgtttagactgtatacatcatatctgacattattgtaactaccgtgtgatcagtaagattcctgtaagaaatactgctttttaagaaaaaaaataacatgctgaggggtgacctatatcccatgtgagtggtcactttatttataggatctttaaaacatttttaatgaactaagttgaataaaggcacaattaaaaactgtcaaaaaaaaaaaaaaaaannnnnaaaaaaaaaaaaaaaaaaaaaaaa

SEQ ID NO: 181 - DNA, 4430 bp, Homo sapiens
  modified_base (28)..(31): a, c, g, or t
  modified_base (1327)..(1327): a, c, g, or t
  modified_base (2233)..(2233): a, c, g, or t
  modified_base (3002)..(3002): a, c, g, or t
  modified_base (3069)..(3069): a, c, g, or t
  modified_base (3561)..(3566): a, c, g, or t
  modified_base (3570)..(3570): a, c, g, or t
  modified_base (3572)..(3572): a, c, g, or t
  modified_base (3623)..(3623): a, c, g, or t
  modified_base (3836)..(3836): a, c, g, or t
  modified_base (3862)..(3862): a, c, g, or t
  modified_base (3866)..(3867): a, c, g, or t
  modified_base (3872)..(3872): a, c, g, or t
  modified_base (4038)..(4038): a, c, g, or t
atccttaattaaattaatcccccccccnnnnggtcttgttcggctcctgtgtgtaggatccagaatcaatagtgaattcgtgggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaanaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgantgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcattnttccccaaattttgcgttgtaggactactgttcgaagatttttggaagaatactgagaacggcatanagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttacaaaaaaaaaaaaaaagctgttgattgtctctgtcattgaaaagttttagtattaatctttttctaataaagttattgactctgaaaaaaaaaaannnnnnaaananaagagttacactattactagaggtgttggtgtacagttttatctgatttgntctgtttaagactaatttttatagactttctaatgttttaaataatggtgcttcaattttaggtggttatgaataaatttgaattttgcttttaatagcaaagatgtgcagtgaactagaatatatttttacatccctgagagattcatttagtagaaaattccaagtatcctgacaagcactctttagctggctagctatgggatgatgtanaaaagcattcaagagctagtttttgntaanncctgnatcaagattaacccagctgtgtcagtttataaatgtatttgtgtatagggtgtgtagtatatatggcaagggttttttccccccacttaagtgattatttttgtgtcacatctaggaaaaccggcagcatgtttctatctatagccagcttcttcgactgtataanagtattctctccagctacgtatatacacacatacatatatatcatagcaattccttgtggtttataacttgcaaatactgctatcagtttataggtaaagaaacagtgtgttaaatgacttatccagggagggtcctgtggcttcatgtttatggagttgctaggtctctgcctcatggtccagtgcctgttaagccactgtgttcattctaataggcataatgaattgttaaagaatttactaaaatctcttccaccaaactttgaaaaataatgaagccgcccccactttagaggctctgtatgaaaaaatgctgtggagacagagccctcctggctccctagctgatcctggagatgcagcaatagatgaatgggttatctctgaattt

SEQ ID NO: 182 - DNA, 4330 bp, Homo sapiens
  modified_base (2)..(7): a, c, g, or t
  modified_base (9)..(9): a, c, g, or t
  modified_base (20)..(20): a, c, g, or t
  modified_base (2452)..(2452): a, c, g, or t
  modified_base (2456)..(2456): a, c, g, or t
  modified_base (3312)..(3312): a, c, g, or t
  modified_base (3550)..(3550): a, c, g, or t
  modified_base (3562)..(3562): a, c, g, or t
  modified_base (3572)..(3572): a, c, g, or t
  modified_base (3598)..(3598): a, c, g, or t
  modified_base (3621)..(3621): a, c, g, or t
  modified_base (3699)..(3699): a, c, g, or t
  modified_base (4140)..(4140): a, c, g, or t
  modified_base (4180)..(4180): a, c, g, or t
  modified_base (4199)..(4199): a, c, g, or t
  modified_base (4203)..(4205): a, c, g, or t
gnnnnnngnggcaggtgccngacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttaggatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgattttttttttttttntccnttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccnttatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttctttttagaaaaaaagaaaaacaaaaacaaaaanaaaaaaaaaaantcacaccatngctcacagaattggcatctcattttngggacctcccatctttctgtttngaaaagtgtacagtagtgcagtgttcctgatgtaactttatggcttacaatgttgacatgtctcaggttcatgtgttncgattggtgttttccgtctcaggtagattgcaaagtgtaggccccacacattggaaaaaataataataaaacaaagcaaaaacaggaaattatggattttagttgtatattggtttatgtattttttcttaagtatacagtgcactgtttgaaatgtattgttgagtattactttgtacaggttgatcactttttttagagtgaagaaagaacaaacttgttttttgtgttttttaaaggaatataaaataatgaaggatgtataattgatgccaaataagcttgttctttagtcacaccgacgtcttatttttccctttaggccagttctgtttttaaggtgtacatggacaatgttacagtgtaagaaactccatatccatatgttcccattcgcattttgtattggttcatgtataccatttttacaaaaaaaaaaangaaaaaaaagaagtactataaaatatctgtcttcttaatnaaaaaaaaattaatgttanaaannnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 183 - DNA, 3387 bp, Homo sapiens
agggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcaaccaggacaccatcaaccgcatcatcaaggtcatgaaacacgaagcctacggagagtgctacaaggtgagctgcctggaaatccctgggccctctgggcccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgagggcccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacatatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgatcgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcactgccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaacgagaacgtggtacccaccgtcctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccaaaaaaaaaaa

SEQ ID NO: 184 - DNA, 2008 bp, Homo sapiens
tgggacactgctcagggaagagcctgctacggtggactgtgagactcagtgcactgtcctcctcccagcgaccccacgctggaccccctgccggaccctccacccttcggcccccaagcttcccaggggcttcctttggactggactgtccctgctcatccattctcctgccacccccagacctcctcagctccaggttgccacctcctctcgccagagtgatgaggtcccggcttctgctctccgtggcccatctgcccacaattcgggagaccacggaggagatgctgcttgggggtcctggacaggagcccccaccctctcctagcctggatgactacgtgaggtctatatctcgactggcacagcccacctctgtgctggacaaggccacggcccagggccaacccaggccaccccacaggccagcccaggcctgccggaagggccgccctgctgtgtccctgcgagacatcaccgcacgtttcagtggccagcagcccacactgcccatggctgatactgtggaccccctggactggctttttggggagtcccaggaaaagcagccaagccagagggacctgccaaggaggactggcccctctgctggcctctggggtccacatagacagatggacagcagcaagcccacgggggcccccagagggaggctctgtgaagccaggatgcctgggcattccctggcaagaccaccgcaggatgggcagcagagctctgacctaagaagctggacttttgggcagtctgcccaagccatggcctcccgccaccgcccccgccccagcagtgtcctcagaacactctactcgcacctcccggtgatccatgaactctgacccctccccagtaaaggcttctgtagagagcatgctgggtctgcatctcctctcgtctcctccatggtggtcactgcccctggcaggtctctgaaagggaaatgcttttctgcggaggcccctgcttgggcagttcacagtgagaccgaccccctctgaatatgataacagcctgtttcacatgaggagatgttaccaatcccgttcgctctgacccttgctggctgatcaccttgagcaacttacttaacatctgtgttcctcagtttctcatgggtaatatagggataattactggcacctgcctcccaggccattctgacgtgtaaccgcatataggagcccactggctgagtagctaccatcatcgctggtggggaaactggtggtaggggtgtgagggtagtgggggtgtcagccccccaggtgtttcagaacaaggcctcgggcactcccaagtctgcctcttggctcccaccctcaaagcccatgttctgcgaggcccaagagaacacatggagtcttagcaaatgcactaatgtattccgggggactgtcacctggcaccactggggcactctgctggctacaactcatacgtcctgtggtggcattgggagagttcccccatgatgagggccaagatagaatctgtaccactcagtgctaccatccccacccctacaccacttccacacaggggcctcatggcatggtcagggtcccagctgtaggtgagagcagggcactgtccagctgtccactggggaagtcaagatgtcctaaggcccaggtcagggcatctggagtctgaaggaccctagttcctagaggcatctggcagcaagaaggtgaggcatcagggaacgggaatcaggctgggactgatcagaggtgaagggacagagagaggagaggaggaagattgagctgggggcaacagccaagctcacctgggcaggtctctgccacctccttgctctgtgagctgtcagtctaggttattctctttttttgtggctatttttaattgctttggatttgttaaatgttttctgtcttctgttaagtgtgttttctctggagatagaatgtaaaccatattaaaaggaaaaagtttcagacaagcaaaaaaaaaaaaaaaaaaa

SEQ ID NO: 185 - DNA, 688 bp, Homo sapiens
atcctaatacgactcactataggactcgagcggccgcccgggcaggtgagacagacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaaaagaaagctacagaagaaactggggctcctccagggtggcagcaacaataaatagacacgcacgtcagccacagcttgaaaaaaaaaaaaaaa

SEQ ID NO: 186 - DNA, 645 bp, Homo sapiens
gcggccaagatgagcacggaaggtggtggccgtcgctgccaggcacaagtgtcccgccgcatctccttcagcgcgagccaccgattgtacagtaaatttctaagtgatgaagaaaacttgaaactgtttgggaaatgcaacaatccaaatggccatgggcacaattataaagttgtggtgacagtacatggagagattgaccctgctacgggaatggttatgaatctggctgatctcaaaaaatatatggaggaggcgattatgcagccccttgatcataagaatctggatatggatgtgccatactttgcagatgtggtgagcacgactgaaaatgtagctgtttatatctgggacaacctccagaaagttcttcctgtaggagttctttataaagtaaaagtatacgaaactgacaataatattgtggtttataaaggagaatagctattggggttagcattgcacaaagcccagtttctttctgtgtttgaaaaagattttgatccccttggaatattaagaggtcaacacgtgattgttgtacgtacacattgtgctctggagtgcctatttattgaaatcattgtaagacctgttataaatttaagtctatttaaaactaaacttgtaatatacatcctg

SEQ ID NO: 187 - DNA, 1266 bp, Homo sapiens
cggctccgcccggctgccgcctaggatgaatatcatggacttcaacgtgaagaagctggcggccgacgcaggcaccttcctcagtcgcgccgtgcagttcacagaagaaaagcttggccaggctgagaagacagaattggatgctcacttagagaacctccttagcaaagctgaatgtaccaaaatatggacagaaaaaataatgaaacaaactgaagtgttattgcagccaaatccaaatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaaagctgcagaaactagaaattcatctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttaccagtatatgttggacctccagaaacaactgggaagttttccatccaattatcttagtaacaacaatcagacttctgtgacacctgtaccatcagttttaccaaatgcgattggttcttctgccatggcttcaacaagtggcctagtaatcacctctccttccaacctcagtgaccttaaggagtgtagtggcagcagaaaggccagggttctctatgattatgatgcagcaaacagtactgaattatcacttctggcagatgaggtgatcactgtgttcagtgttgttggaatggattcagactggctaatgggggaaaggggaaaccagaagggcaaggtgccaattacctacttagaactgctcaattaagtaggtggactatggaaaggttgcccatcatgactttgtatttatatacaattaactctaaataaagcaggttaagtatcttccatgttaatgtgttaagagactgaaaataccagccatcagaaactggcgtcgagtctaga

SEQ ID NO: 188 - DNA, 639 bp, Homo sapiens
atgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaa

SEQ ID NO: 189 - DNA, 4140 bp, Homo sapiens
  modified_base (319)..(319): a, c, g, or t
  modified_base (690)..(690): a, c, g, or t
  modified_base (1263)..(1263): a, c, g, or t
ggtttttttttttttttttttttttttttttttttttttttttttttttttttttttttttttttttttttttttttttttttttttaactgaatgcataactttattaaataaatgctttgtcatgacaaaagacaaagatcaaggagtaacataaattataagttgaataaatagtatacagcaatcttcactttttaagaaaatgtgagatcctttgttggttttttatttccttaagtacaaaatgctaaacgggagccgagctcttccgcattcaggtgttttttttttttttttcggcttttttttttttttnctcacaaactggttgcatttgttgatttatttttccatccttttcaccagtaaagattatcatcgtttatttttgtttttaaagttgaaaacaaaaaagaggagagaacagagttatggtatgaatgtatgtaaaactatagagaactacagtaatatgtactgtggttattgctgtcttcaaaaaaaaaaagaaaaagaaaaacaacaacaacaacaacgaaaacaaccggtaggcaactcggaatctgaaggaatcttgtctgacaactgtgctatccatgtgggctacggtgtgacagtggcggtagagaggagactccggctggcgaccggggactggtggagtggggtgagcgggcacagggaagnctggggtccccttcccctcggaccctccccaccttccctttccccatccaaaaggatttcaggagaggaggccagagtctgtgaaatgactaaactatatactccattagaaaaccaagaaagtatgtttgaaatagaaacaaaagcctaagagaaaataaaaagtggagaaacagtgcaatgtaattcttgcactttagtggttttaaaaacacagacagtacaaggcccaggttgctggctggtgaaacccctgtccctcgtccctcctccactttgcaaaacggagcctcctttctcttggaagccagacatatcctctctgacgctatggggtttcttctccttagagctcttctctgaggttcccattctgggccggagccctctcaggagtgagtggatgggtccggggtactgtcccaccttgaggggggcttggcggttgccgtggcagccctgtctcactaaccggtgcgtggcgggagcaggtggttgaggcccaccctctaggggaggccagccctgtgggggtaccatggaggccacagaggtggtggtggggagatgggntgggagagaaggggcatgatcagaaaagggcctccctggacctcgtgcgcctgccttcctcccctcatggggccagtgtccccaggcctgtctgtctaggcctggctgtcaaagaaaggttccagtctcttcctccccatgtgccctgctttgccaggtgggtcagggcaggctggaggaaggagggtcagtcctggctgggcttccctatctcctggcagtcgtgggaaagacagaggcatcttcctcactggtggagtgaggcacgaatctaaaggggatgggaagaccttctgtgggtgtgagcatgggagtgggcagcacttagattcggagccatggatagtccggagtccaaggtctctgggtgagcagacagtcggccaaaggccagcctggagtcaaagagaccagacccctgcttagattgccatactcgcaccattccaaacctgcctccctcacaccctgccatgggggaagaggtgccgtcttcctccagtgcctcccttcccaggatctccccaccctgggctcagccagaactcccatttgggaggcttagttccatgtgtccatgaaggcccagcttctctggggagtgaccagctgcccaggagaaactcctgcatgcagaagagactcacaggtttgggttcgcaggcacgaactttggaaaccggaagagtctggcgcacttacaccaggctctaatcccccacctgatggctggcagcaaagagccaacgcaaggggcagaagcctgctcaaagtccagacacagtccgtgaagagagagcccctctcaagaattaggtccaggctgggaggaatgtggggggagcttgtagttcctggctcagtcttttctcaggggagtggcaccccagtatccacttggcagatcctagttggataactgctcaagatgcaaagggagaatgggtggaaagaacagtgacgtggaagaggtttgggatactggcctaagacatacagaaacgtgagttgggtttaggggacagctgtgcagagagatggggcatgctgactcggcaggtcaaggccttgtggctgctggccctatcgggcccctttgtctcatgaagattgagcacttctcctgtccccagccaactgtcctgtccaggggcataggagatagcccccaagttctatagctatagggttcccatcagttgaaacagatttgctttttcgctattcctcttcgtagccccaaattcgttgttggaggcggtctccgctgtgtcatgccatgagcaaagagtgaagagagctgtgtccacagcacgaaggggtctccttggccagtgtccaagccccctttcctggatatcttcagccttaaagaacagtcacaaggccacccattggttgaggaagtcattggagaatgggagtttcggaatctggctgccgagtgacagcatccctgaatcatgcgttccctgcttgtcccagctttccttccatcctccaccccagggaggatgcagggactggccagaatggaggaagagctggaaagactcgtgggcctcagtccctcattgcaggctgaaggtgggcagcggagcacatagtcttgtcccttccaaagcatggccagtttagactgattcttcctatctggcttctaaagtctagcaccctcctaaagttactcaccttccctggctctgcggcctggattaagctcatttctattttgcaacccattcccccattttcctctctttcctctcaaatcctagaaaatacatatggtggggaagctaaggaaatttctattggcttttccccctttctgctgctttgtgccaaagctagaatggaacagtcagccccctctcccttcagccctctgttcctccccacatcgactctggccggaaccatccatcttactgttctcctgcatctaaacctttttgccaccatctccctctgccatctcttacttcagtctccctcctgctctgccagcatggagagtgagggaggcttccaaaaatgcacattctgttcagatgaaaggaaaaggctggggtgggactggtggatccatcgtggacctgttgggctcatgtggtgtggtgtccggagactgtgacttcctgagggtttaaagactaaaatgggatggactgaggcgcgtgctgtgtgcaccacggagggctggcctctgcctggctcggtgggtgcagatgaacacacgtggggaatcactgtcaaatccagtactgtgccccacaaaaaagctgagtttattgctcacgggaaactctgcctcgaggcaggcaaaaatgctattacgggttgtattaggagaatatgggttttctcagttttcccagaatgaggaagctcctcaatgcccctataggaactactttgaaaagttaatgcaaacctttgaaagaaaggaagaaagaaaaaaacaaagaaaaagaatagatttatatgcctatatatgactatatggagtcctgtagataaatacgagcccacttttttttttcagcctatcctcccccacagaggctgctgcgctacttacaaattgaattaaatgagggctgaaacggcacgcttcagcatgtactgtagtcaccgtggaagaacaagtctttccaatattggggcatgtattgatttctaaaaaatgtctgcctggggaatgaaatatgcacatgtatttcatattcacagatctgcttccgaaaacctctctatttaatatcactcaattatgaatttgttttgctttcagaggaatggaatgcattttagtttttataaatttggggagagacaacactctgcccaggtaagaggagaggaagttcaggg

SEQ ID NO: 190 - DNA, 3460 bp, Homo sapiens
  modified_base (377)..(377): a, c, g, or t
  modified_base (444)..(444): a, c, g, or t
  modified_base (674)..(674): a, c, g, or t
  modified_base (820)..(820): a, c, g, or t
  modified_base (827)..(827): a, c, g, or t
  modified_base (872)..(877): a, c, g, or t
  modified_base (979)..(979): a, c, g, or t
  modified_base (1074)..(1075): a, c, g, or t
  modified_base (1089)..(1089): a, c, g, or t
  modified_base (1186)..(1186): a, c, g, or t
  modified_base (1297)..(1297): a, c, g, or t
  modified_base (3146)..(3146): a, c, g, or t
  modified_base (3173)..(3174): a, c, g, or t
  modified_base (3176)..(3176): a, c, g, or t
  modified_base (3227)..(3228): a, c, g, or t
  modified_base (3421)..(3421): a, c, g, or t
ttttttttttttttttttttttttttttttttttatcattcaacattttatatcagaaaagatcagctttccaacatttattccatggaatgagtgcacagcattttcatgaactacctcagggctacatcagtacaaaatagtttaaattagtaaaataaagtagtttcaaagggaaatcattgacgacttcaggataagtgccaccaccatttgggaacagaggatagaaggtagccatgtggttattccatgatgcaggaatcaggtcggcaggtggactgtcattgctgtcttgcggcagctggcctctgccttcagggtaccaccgtctccaggacacaaatgggcagcagaaaaatgtcaccttgttgatnctcagcagctcatctattgggacaaaacttccatctcggccaagggaaatactctgttgagtgaccnagcggggcccagcccccagccctatttatctcatcaatatggttcagggaagataaaaaagagtgttctatgggatagaaaggtgggaataagaaaaaactaagtggctgggcatggtgagtcacgcctgtaatcccaacactttgggaggccaaggtgggcggatcacgaggtcgagattgagaccatcctggccaacacagtgaaaccccgtctctactaaaaatacnaaaattagccgggcgtggtggtgcacacctgtagtcccagctactcaggaggctgagacaggagaatcgcttgaatacgggaggcggaggctgcagtgagccgagacagtgctgcagtgagccgagatggcaccactgcactccangcctggngacaaagggagactctgcctccagaaaaaaaaaaaaaaaaaaaannnnnnggaaaggaaaagctaagcagatgacttatgtggcaaatgaggaatcaaattctctatttgtggtctgagatgccttttcctggcccagttttctgtccaaanggctcttttaacctccaagttatacactattaatggtaggcccatagtggggcggggtgtgatgagctggaaaagcatgatgtgcgtgtgcgtgnncgggggtggggccnatcatcagaatttgcacaggctgctgggaagagccatggctgtctgctgggaactctgctggggcaagcaagccctttgactctcctgcccatctcnagaatatttctaaaatgttttaaccagcaagttaaaaaaaaatttaaccctctttatatagataccctggacaccttttcttatggttcctccaagatgattataacttcngtctgacactatatattcctttaataacaaaatttcccagaaggctcacaaatcatggttggcagtgcagccttttcaatactggacacatcccatgctaaggccctctgcacagattttgtttactatcactggcgatcagcccaaacttctcaccccatatatcaacccaccccgatgtgtacaccaggtactatgtgacccacctactactggctaatgatgcaacttctgagagacccttgcaccctcactgcacgtcttgccacacaggtggcttggtgtcacgtactccctggcaccatctggttcatgccaggtttagagttcatcgtgtttggcttcctggtctttgagtttaaattcctcggctgtgaccttcccatctccattccggtcctggttggtgaacatattcttcacaatcagctcagcatcaaagccaggagcgagtttccctttgccagatgccacctgggcgtgaatgtactctgagaactcttccaggaggacttctccgttgccatccttgtcaatttcttcaaagaggttgggtgacacctcaccattccatatgaacatgtacccctcaggaaggccagccaccagctccagcagctcaatgtcaaacactaatacggcactgccgggcacttctccatccacgccagcttccccatagcccaggtgaggcggaatgatcactgtccgtttctcgccaacgcacatctctctgagacccatgtccatccccaacacaacttgcccagatcccagaacaatattgtaagttttgcctaaattccacgtggagtccagcagggtcccatccagaagtgaggcattgtagtgatatttgaggtaatctcccttcttactcagcactgagcagtcagggggtttgtagtgggaggtgatgctgatggagtccgaagggttgtggaagtcgatcacatggatgtcaaacaccagcacagccgagccggggatattccctcttccttcctctccataccccaggtgaggcgggaccacaatccttcgcttttctccaatgcaaacaccaagtagaccttcatccatcccaggaatcacgtagccctgcccaatgtacgtgtcaaacgtgcggttccgagagtagctggaatcaaagagggtgccatccagaagcgtgccattgtaatgatacctgagaaagtccccactttgacttatccgctcacagttttcaggtactaccttgttctcaatggaaatgctgtccttggggttatggaggtccaataatgcaacatcaaacaccagagatgcctgaccgggaatgtctttcccatctccatcctctccataggccagaaaaggaggaatggtgatgatgcgcttctcacccacacacatccccagcagccctttatccattccaggaatcagccagccaattcccacatacgtgtcatatgttttcatgcgattgtgactcgaatcaaacagagttccgtccaggaacgtcccgttgtagtggtacctcacaaaatcagacacctggatggtccgagggcaactcgggggcttgaaataggtgtgaatctgaacctggtcttcagaattccaaatatccatcagaagtacatcaaaatgaagcactgaattgggggggatcacaccagaaactccttcatttccgtaggcaagctttgggggaatcttcacgaaacgtctctcgtttacgcacatcccaacaagagcctggtccatccctgtgatcagctgtccttttcccacaaacacattgaaagtggagtctctgtcatagctggagtcgaacttctggccgtcggggaacgtcccnacgtagtggtagcgcacgaagtcgccnntngcgcacggtgcgcgggcactcgtcgggcacgaagcgccgctcgatctgcanntccgcgtcggagcccaggcccgccacgggcgctgcctgcccggtcacccagagcagcagcaggagcagcggtggcggcgggggcctccagccccggaacgccatcggggcggcgagaagagtggcgcggacgcagcgcggcgctcgggcggcacgggtcggcctgggcgttcggctgcgtttgcaaacgtggnccgggtctcctggccctacccgggctgcagccgccaccc

SEQ ID NO: 191 - DNA, 6934 bp, Homo sapiens
  modified_base (1128)..(1128): a, c, g, or t
  modified_base (1158)..(1158): a, c, g, or t
  modified_base (1266)..(1266): a, c, g, or t
  modified_base (1339)..(1339): a, c, g, or t
  modified_base (1341)..(1342): a, c, g, or t
  modified_base (1421)..(1421): a, c, g, or t
  modified_base (1531)..(1531): a, c, g, or t
  modified_base (1608)..(1608): a, c, g, or t
  modified_base (1617)..(1617): a, c, g, or t
  modified_base (1644)..(1644): a, c, g, or t
  modified_base (1647)..(1647): a, c, g, or t
  modified_base (1653)..(1656): a, c, g, or t
  modified_base (1935)..(1935): a, c, g, or t
  modified_base (1965)..(1965): a, c, g, or t
  modified_base (1974)..(1974): a, c, g, or t
  modified_base (2143)..(2143): a, c, g, or t
  modified_base (2297)..(2297): a, c, g, or t
  modified_base (2537)..(2537): a, c, g, or t
  modified_base (2802)..(2802): a, c, g, or t
  modified_base (3897)..(3897): a, c, g, or t
  modified_base (4442)..(4442): a, c, g, or t
  modified_base (4602)..(4602): a, c, g, or t
  modified_base (4791)..(4792): a, c, g, or t
  modified_base (4951)..(4951): a, c, g, or t
  modified_base (5054)..(5054): a, c, g, or t
  modified_base (5134)..(5140): a, c, g, or t
  modified_base (5239)..(5239): a, c, g, or t
  modified_base (5626)..(5627): a, c, g, or t
  modified_base (5629)..(5631): a, c, g, or t
  modified_base (5638)..(5638): a, c, g, or t
  modified_base (6123)..(6127): a, c, g, or t
  modified_base (6130)..(6133): a, c, g, or t
  modified_base (6137)..(6137): a, c, g, or t
  modified_base (6141)..(6141): a, c, g, or t
  modified_base (6143)..(6148): a, c, g, or t
  modified_base (6154)..(6155): a, c, g, or t
  modified_base (6157)..(6157): a, c, g, or t
  modified_base (6160)..(6161): a, c, g, or t
  modified_base (6163)..(6164): a, c, g, or t
  modified_base (6262)..(6262): a, c, g, or t
  modified_base (6286)..(6286): a, c, g, or t
  modified_base (6296)..(6296): a, c, g, or t
  modified_base (6315)..(6315): a, c, g, or t
  modified_base (6331)..(6332): a, c, g, or t
  modified_base (6336)..(6336): a, c, g, or t
  modified_base (6339)..(6340): a, c, g, or t
  modified_base (6358)..(6358): a, c, g, or t
  modified_base (6365)..(6367): a, c, g, or t
  modified_base (6369)..(6369): a, c, g, or t
  modified_base (6371)..(6383): a, c, g, or t
  modified_base (6387)..(6388): a, c, g, or t
  modified_base (6390)..(6390): a, c, g, or t
  modified_base (6405)..(6405): a, c, g, or t
  modified_base (6460)..(6460): a, c, g, or t
  modified_base (6563)..(6563): a, c, g, or t
  modified_base (6929)..(6929): a, c, g, or t
cgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggcttngcagaatcttgcactcatgagacctgaatnggtaataccccctgtacttgaaagaacatatcctgcattagagacattaacagaacctcaccagctcacagctactttaagttgtgtaattggagtagcccgcagttnggtatcaggaggcagatggtttcctgaaggtcctacacatatgctacctctgttgatgagagcattgcctggngnngatccaaatgactttagtaaatgcatgatcacattccagttcatagcaacattttctactctggtgcctttagtagatngttcatctgtactacaagaaagaaatgacctcacagaagtggaacgagaactttgttcagccacagctgaatttgaggatttcgtcttacagtttatggacagatgtttnggacttatagaaagtagcacattggagcaaacaagagaagagacagaaactgagaaaatgacacacttggagagttnggtcgaatnaggtctgtcttctacgtttagtacaantcntcaccnnnngttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggnagttgcttctttatagggagcagcttgtanagattctcncaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaanccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatantctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcatngtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcntacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgnctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatgtcgactttatgtactacaaggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaanccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatatngaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgccttnnggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtctttnggaggacgaacaactggaggttcgagaaatggctgctactaccttaagcggtctgctacagtgtaactttcttaccatggacagtcctatgcagattcatttngagcaactttgcaaaacaaaactacctaagaaaagaaagcgagaccctggttctgtaggagataccattccttctgcagnnnnnnnagttggtcaaacgccatgctggggtgctaggacttggtgcatgtgttctttctagtccttacgatgttcccacctggatgccccagctcctcatgaatntcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcnntnnnttttttngaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaannnnnaannnnaaanaaanannnnnnaaaaannanaannannttttgaccctctgaaaattattatacttcacctaaatggaagactgctgtgtttgtggaaattttgtaattttttaatttattttattctctctcccntttttattttgcctgcagaatcgnttgagagacntaataaggcttaatatttnaattgatttgtttaannatgntannataaatgtaaaagagtgntataaannngnannnnnnnnnnnnncaanncnattgtacagatgcanccttttacacaacatcattgtgtaatttgtaaagattcacgtgtagttctttatnatagtgattttgggctttgtacccactgaatgccattttttgtgtttttaaattattttctttatcttgttacaaaaactgagatgtggggtttttttttttncagttcacttatcattagaatgtctgaacttttatgtaacatttttgtgtgcatctctcaatgctaacaccacatgtttgcctatgacaagtttatagagtgaaaggtatcttctgggttgaaataattcacaaattggtgaatgtcatcttgcaacacaccctgtacagtcttccttaaaggaacactacagtatatttttagtatctacatgctgaatgactgaatacagacctaagcacagcagtggtcctggtacagtatttaagtgtcggcatacacaggcgtaatccctgtataaagtagtgccaaactgatttcagttgtgtaactagtttaaaacccaataaatggattctttttaanaaaaa

SEQ ID NO: 192 - DNA, 2272 bp, Homo sapiens
  modified_base (117)..(117): a, c, g, or t
  modified_base (120)..(120): a, c, g, or t
  modified_base (122)..(122): a, c, g, or t
  modified_base (124)..(124): a, c, g, or t
  modified_base (126)..(129): a, c, g, or t
  modified_base (143)..(145): a, c, g, or t
  modified_base (148)..(148): a, c, g, or t
  modified_base (152)..(153): a, c, g, or t
  modified_base (595)..(595): a, c, g, or t
  modified_base (1197)..(1198): a, c, g, or t
  modified_base (1215)..(1215): a, c, g, or t
  modified_base (1219)..(1219): a, c, g, or t
  modified_base (1232)..(1232): a, c, g, or t
  modified_base (1234)..(1234): a, c, g, or t
  modified_base (1240)..(1242): a, c, g, or t
  modified_base (1250)..(1253): a, c, g, or t
  modified_base (1258)..(1259): a, c, g, or t
  modified_base (1287)..(1287): a, c, g, or t
  modified_base (1333)..(1334): a, c, g, or t
  modified_base (1369)..(1369): a, c, g, or t
  modified_base (1381)..(1381): a, c, g, or t
  modified_base (1385)..(1388): a, c, g, or t
  modified_base (1390)..(1390): a, c, g, or t
  modified_base (1396)..(1397): a, c, g, or t
  modified_base (1399)..(1399): a, c, g, or t
  modified_base (1417)..(1418): a, c, g, or t
  modified_base (1584)..(1584): a, c, g, or t
  modified_base (2199)..(2202): a, c, g, or t
  modified_base (2205)..(2209): a, c, g, or t
gtaaattcacaaagctttggaaggagaagcaataaatttttgttttcaaatggcttgatgtaccttttttcctgttgctcttgaaatatgtttaactcctcatgagagaaccctggnttntntntnnnntttttttttttttnnnttntttnntggtcagcagctacctttatttggatcacacacgtgagtcagacagtaccactaatcgggccaatatggcttgtgagcaaaatgggtgaaaatagagggaactgactgggacctgttgtctaacatcattttaaggttgaacttgagcaaagacttagagaaagctgatggaatgccaagcatcaacgtgaagagaccctctatgcacacagtggatatgttatgcctggctgtagccaccttctcttctgaaaacaagatgggaatgacggaactgtattaaaagattaagttatccactagggagcatactagcacacttccagatcagccttgagatgctagacttcagatacagggacttgtgtcaggtggcctctagaaatgtggaagactaagatttagaaataaactaatttaaaagcaaacaaacaaaaaaaanctttcgcctaggatgatctgtttacaacagaaacaaaaacattttccagtttaatccatttgactgaaagtcattgttgggctgacccttaaggaaaacttaagtttaaacttcctttgcatagtatgttttctcttttttccttgggttagaggtgggaacaagaaaacattgatatagttttgaattaacattaaagaggcaaaatttcacatttaaaatggcccaaaatatcccactattcattttgctgacaggtgatacactcttgagaatcaggagtggagggtttagtcataagcatatatgctgtgggtcaggtgactcatgaacatgtcaaacaggccatgttctttagcagtttctggtctggtcctgcttttagtaatcttgcggtggaactcaggcacacagttatttggtaccacttccttataacctagcccacacccctttgcccaccctcaagccgatcggtctgttcatcccagtgcccttagaaggtgaaggtttgggctgggcccagtggttcacgtctgtaatcccagcacttagggagactgaggtgggcagatcacttgagcctaggcgttcgagaccannacctgggcaacatggcnaaanccctgtctccacnancacacnnnaaaaaaannnnaaacnnaattagccatacgtgttggtacacaccntgtagttctagctacttgggaggctaaggaagatggcttgagcccnnggaggcggaggttgcagtgagccgagatcatgccnctgccctttacntccnnnncntgggcnnancagagtgagactgtcttnnaaaaaaaaaaaaaaatggaagaaggtgagggtttgacatggttcctgacaccatcttgctcttgtgcattgctgccagtgtttcaaatgctgctgaagacgtgggttctgagcagtgttccttgtattgtatccaacaagcaaccaccctgtaggcatctctaccntgggccagtggttgtttccttcattttttttttcttttctcttcatacttgtagtaggggctccgcaacatgaaaattaaaagtatgaatgggatgagtaagtagggggcatagacagacacaagggttaaccgttcatgcaaagtctcaggtctttgtcccttgaaaccactggctttggagaaatcctcaaacagaaatgtggagagtatcggaattaaggttgtcatggtgtgaacagagtagatgattgcaggagttcgaatccacttgcagcttcctttgaggaaggcatacgttgcaatgggaaagaaaggcagctgaaacacaagctcgcaaaacagaaaggacttaaaccaggctgggggctcctgtagcagtgggtctttgaactccttagcataccacttcagcaggtttctaaactcgactgggtagagctcgcgcggcagcaccgcctgcaggtccatgaacagggtgatggggatgtggctgaggaagtagaggcccagcagccactccacgcagcgcctggttgccggagcccccatagtctgtcggttgggcctggacccgctgatgtgagaagaggggccaaatccgcgcgccttcccnnnnccnnnnncctcggtcgccgccttgcccccgcgagggctaggcagaccgcttccattggctggcgagaaga

SEQ ID NO: 193 - DNA, 1131 bp, Homo sapiens
  modified_base (27)..(27): a, c, g, or t
  modified_base (44)..(44): a, c, g, or t
  modified_base (58)..(59): a, c, g, or t
  modified_base (65)..(65): a, c, g, or t
  modified_base (69)..(69): a, c, g, or t
  modified_base (83)..(83): a, c, g, or t
  modified_base (85)..(86): a, c, g, or t
  modified_base (90)..(90): a, c, g, or t
  modified_base (122)..(122): a, c, g, or t
  modified_base (138)..(139): a, c, g, or t
  modified_base (179)..(179): a, c, g, or t
  modified_base (183)..(183): a, c, g, or t
  modified_base (187)..(187): a, c, g, or t
  modified_base (208)..(208): a, c, g, or t
  modified_base (224)..(224): a, c, g, or t
  modified_base (349)..(350): a, c, g, or t
  modified_base (355)..(355): a, c, g, or t
  modified_base (362)..(379): a, c, g, or t
  modified_base (382)..(385): a, c, g, or t
  modified_base (388)..(388): a, c, g, or t
  modified_base (396)..(396): a, c, g, or t
  modified_base (398)..(398): a, c, g, or t
  modified_base (1030)..(1030): a, c, g, or t
  modified_base (1104)..(1104): a, c, g, or t
  modified_base (1120)..(1120): a, c, g, or t
  modified_base (1123)..(1123): a, c, g, or t
  modified_base (1128)..(1128): a, c, g, or t
gcagatgagccttccggtgtctcctcnccccagtgtgtcatttnccagcagtggaccnnagcccnacgnttacaaggactgcntnntccncggcccccaccatcatcaccacagtctgtttnggctatacttcccccnncccaccagccttgtaattggctaattactggagatgaatnttgntaancagaagccttcttctcttctnccatctgcttctccantatttgcccattgtacaccccccttttcctcccactgaagccccagttagtcagcagggcctagagtccctgtccccttttgagtacagccaagtgggggattccccagctcttaagtattgggnnagganccagggnnnnnnnnnnnnnnnnnnttnnnnttntttttttntnttcaggggtactgccaggtagcaggctttattgggaagggacaaagcctcaggagctgggtgccccagaggctgctgggtcttgagccacagctgcagccaatgcagcagctcgcgcctccttcttccgtttctgtttttcctccttgaggcgcttgcgctccttcttctctaggtcctggagcagctcctggaagcgggcactccttgggtccacctggtagcccaggagctcctgggcctcagcctgcagtcgggccctcctctccttgtcagcctgggccttctcccagttctcccgctgctgctgctgccagttcacaatcatctgtggcatcttggccatgcactctgcgatgtgctgctccctctcccgacgcttctgctcttcggccagctgcttcacccgcagcgactcctgcatggtcgccaggctcgggtaccattcgcgttcttcggcctccagctcccgcagctgctccggcgacggccataacgaaccggggaccaccccggaggcggcgccgtaacgcgcgaactgcttagccgcgtagcgcggtcccagctgccaccgcggggtcaggaggtcctcggggtctggccaccggggtcccggcctgcggcgcgggggcngccgcgcccggtagccacgggaacccggggccagggtcgccgccacacctagtaggctgcgtgcctgtcgcacnggacgccgccatcttngcngtgcnggc

SEQ ID NO: 194 - DNA, 467 bp, Homo sapiens
  modified_base (16)..(17): a, c, g, or t
  modified_base (29)..(29): a, c, g, or t
  modified_base (311)..(311): a, c, g, or t
  modified_base (314)..(314): a, c, g, or t
  modified_base (318)..(318): a, c, g, or t
  modified_base (321)..(321): a, c, g, or t
  modified_base (430)..(441): a, c, g, or t
  modified_base (443)..(443): a, c, g, or t
  modified_base (456)..(456): a, c, g, or t
tttttttttttttttnntttttttttttnttgagacacaaaatttaatttaatagaaattttgtttgtagttcttacattctcagtgtgagccaatctgggacccactgccccacccagaagtggcccagtcctgggggcaggggagaaagggaggggtgaaatgagaagagccccgttcttcctcagtgctggggggttggagacaccacccccttctgctgccctcctctgggctccaggaaggagagcagatgaaatctcaggcctgtggcttctccacaccactgccccccaggttggaggggagcnaanaganganagaaggggacagaggcaagaaaagatgttgatcaagaaagatgagaaccaggggtgagggctgaaggagaatcaaagataaaataccagtttaaaaaaaaaaaaaaaannnnnnnnnnnnanaaaaaaaaaaaanaaaaaaaaaaa

SEQ ID NO: 195 - DNA, 743 bp, Homo sapiens
  modified_base (1)..(1): a, c, g, or t
  modified_base (3)..(3): a, c, g, or t
  modified_base (465)..(465): a, c, g, or t
  modified_base (616)..(616): a, c, g, or t
  modified_base (618)..(618): a, c, g, or t
  modified_base (638)..(638): a, c, g, or t
  modified_base (660)..(660): a, c, g, or t
  modified_base (663)..(663): a, c, g, or t
  modified_base (671)..(671): a, c, g, or t
ntntttttttttttttttttttttttgacctggaccctctgcatctcagaaaggtttattatcaattgaaggaggtaacatgtagcctttgctggggacaaagatgcaacaagtctctgccccatcctaggtgctgccccgtgtagggctcttcccaggcccgccccccttgggcagcctggtagcgctgggctggcgtggcatcctctggctggatccttcgcggctgctgcgttccgccagggccaatgctcccccgagggcagcgctgcctttgtttctccctcgggtctcgggcacgctcgacgtgggcagagacacggccgcagggtcctggggctcgctcgctagcctctgcccggcacacatggacttgagcatctggaagacggcgaggggggccacgttcagcttcagcaggtccaccaggatcttgaacacgtcggggtcgatagcgccgcccgnccgcctgcgccagctcgtacagctccatctcctcggtgctcagcaccttcttccgccgcagcgccagcttctgccgggccgcctccagccccgggggcgccgccgaccccggcccaggccctacgccctgcgccgccatccccgcggcccncngaaaggtgcgctccgccccngccgcgccccctagcggctgcngcnccaccacncctctccctgcagcgtcaacgtctggcctcccgggctgcctggcgggaggggcgggagcgcggggacccgct

SEQ ID NO: 196 - DNA, 1735 bp, Homo sapiens
  modified_base (973)..(973): a, c, g, or t
  modified_base (1300)..(1301): a, c, g, or t
  modified_base (1480)..(1480): a, c, g, or t
  modified_base (1492)..(1492): a, c, g, or t
  modified_base (1497)..(1497): a, c, g, or t
  modified_base (1508)..(1508): a, c, g, or t
  modified_base (1519)..(1520): a, c, g, or t
  modified_base (1530)..(1530): a, c, g, or t
  modified_base (1537)..(1537): a, c, g, or t
  modified_base (1552)..(1552): a, c, g, or t
  modified_base (1566)..(1566): a, c, g, or t
  modified_base (1568)..(1568): a, c, g, or t
  modified_base (1607)..(1607): a, c, g, or t
  modified_base (1660)..(1660): a, c, g, or t
  modified_base (1675)..(1675): a, c, g, or t
ttttttttttttttttttttttttttttttttttttctgtagcatagctcattttattgtttaaacagtttttgcataggaaatatatccgcttccagtaattgactgcagtatgagcagctgctagcagtataggctggatataacagtaacaatcacattaagtcaagcttgatttacaccagtttaaaacttgtggcaattgagttcatttgcaacccacaaaaagtacccaaagaacgttatcctccaaccgggcacaataaaaccttcactaacattctggcccagtctggggttgatcccagaggcctgaactctagaaattaagtaactgtcgtataatacatcctactgctaaaggtttgttacatggagattgtgcatgtgcctccttttgtaaaaaaatttaattaaaatacaaggttctgtatttatggcccatgaggacaaaatgccaaaagttttaaaatggatcaaccctggtgtgtagctagcaagcaataactgactactcgtcacctacagttgtactaaatgtatctaaagaaacacacagtcctacaaaagttgttctcagagaaatatcattgaggtgggggcagctcttcccaggatgctaaaagttctatatgatataagcacaaattaacagcttgatgaagacataatctactgcagctttgagaaacctatgcctgggatgtagttacccctcacattctacaatgttgtagagattttttttcccaagaaaatgtcatttgaaacatatttacaactgaactcaacagagactgtgaaattgaacaggcactgctcatttgtttgagttttttggtaaacattttgctggtttttttttttttgtttgtttctttcttgttttgcatcaacttttatcagtccatgcaacttcaatgccctcgatgaaggatgcataaaaagccatacttcttaaaaaaaaaaaaangaaaaaaaaagacttccttctgcataaagagatatatttgccacatcagtccctgtagcacagttttcaaaaccattctgtcaaaaatacagtaatacaagactggctttagtgtcactagcttacactgcttttcatgtatttaggccacctgttgttcctggtactgtatcatgcaataagtcatcaagggcttagtctagtgtaccggtaagctagtggcactgaagcgcttttcacaatctcaacatacatttgaattgcaacacacagatatttctagagtattaactagtgaacccttttattattaaaaaaaaaaaaaannctacttacaaccattgaagaaaaaattgcaacaaaaaatgtaaaaattgaccgtctccaacttgtcccctttactattaacaatgtgaccaacagatctgtggcacggacacagtacaaagagttgtcatggcaatgagtttggctgatgcaaaggtcattgtgcagggtcaaagggcnaaaatcagtggnccatngttaccccccnactgcagggcnntccactccanccacacnattttagggaattanaaaaaacagggganantaccagaaagtgccaaatatgaagaaggcagctttcagntccttcagcatggagtagaacattcatttttgagcttttactattgaacttgnatagcctgcacattnaaaaaaaaaaaaaaaaaaaaagggcggccggctcgcgatctagaactagtcggacgcgtg

SEQ ID NO: 197 - DNA, 1735 bp, Homo sapiens; identical to SEQ ID NO: 196
  modified_base (973)..(973): a, c, g, or t
  modified_base (1300)..(1301): a, c, g, or t
  modified_base (1480)..(1480): a, c, g, or t
  modified_base (1492)..(1492): a, c, g, or t
  modified_base (1497)..(1497): a, c, g, or t
  modified_base (1508)..(1508): a, c, g, or t
  modified_base (1519)..(1520): a, c, g, or t
  modified_base (1530)..(1530): a, c, g, or t
  modified_base (1537)..(1537): a, c, g, or t
  modified_base (1552)..(1552): a, c, g, or t
  modified_base (1566)..(1566): a, c, g, or t
  modified_base (1568)..(1568): a, c, g, or t
  modified_base (1607)..(1607): a, c, g, or t
  modified_base (1660)..(1660): a, c, g, or t
  modified_base (1675)..(1675): a, c, g, or t

SEQ ID NO: 198 - DNA, 1192 bp, Homo sapiens
  modified_base (2)..(11): a, c, g, or t
  modified_base (13)..(13): a, c, g, or t
  modified_base (15)..(17): a, c, g, or t
  modified_base (432)..(432): a, c, g, or t
  modified_base (442)..(442): a, c, g, or t
  modified_base (700)..(700): a, c, g, or t
  modified_base (714)..(716): a, c, g, or t
  modified_base (721)..(721): a, c, g, or t
  modified_base (727)..(727): a, c, g, or t
tnnnnnnnnnntntnnntttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaanaaaaaaaaancttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgtncctgtttatttttnnnttttntttttntttcactggaaaggaaagatgatgctcagttttaaacgttaaaagtgtacaagttgctttgttacaataaaactaaatgtgtacacaaaggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgc

SEQ ID NO: 199 - DNA, 6691 bp, Homo sapiens
  modified_base (276)..(279): a, c, g, or t
  modified_base (285)..(285): a, c, g, or t
  modified_base (726)..(729): a, c, g, or t
  modified_base (732)..(732): a, c, g, or t
  modified_base (735)..(736): a, c, g, or t
  modified_base (868)..(868): a, c, g, or t
  modified_base (1207)..(1207): a, c, g, or t
  modified_base (1212)..(1212): a, c, g, or t
  modified_base (1471)..(1471): a, c, g, or t
  modified_base (3905)..(3905): a, c, g, or t
  modified_base (4034)..(4034): a, c, g, or t
  modified_base (4951)..(4951): a, c, g, or t
  modified_base (5086)..(5086): a, c, g, or t
  modified_base (5810)..(5810): a, c, g, or t
  modified_base (5817)..(5817): a, c, g, or t
  modified_base (5874)..(5875): a, c, g, or t
  modified_base (5884)..(5884): a, c, g, or t
  modified_base (5889)..(5889): a, c, g, or t
  modified_base (5891)..(5891): a, c, g, or t
  modified_base (5898)..(5898): a, c, g, or t
  modified_base (5908)..(5908): a, c, g, or t
  modified_base (5924)..(5924): a, c, g, or t
  modified_base (6004)..(6004): a, c, g, or t
  modified_base (6639)..(6641): a, c, g, or t
atgaaatggaaacatgttccttttttggtcatgatatcactcctcagcttatccccaaatcacctgtttctggcccagcttattccagaccctgaagatgtagagagggggaacgaccacgggacgccaatccccacctctgataacgatgacaattcgctgggctatacaggctcccgtcttcgtcaggaagattttccacctcgcattgttgaacacccttcagacctgattgtctcaaaaggagaacctgcaactttgaactgcaaagctgannnncgcccnacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggnnnntancannatggttggggaacgtgagagtgaagtagccgagctgactgtcttagagagaccatcatttgtgaagagacccagtaacttggcagtaactgtggatgacagtgcagaatttaaatgtgaggcccgaggtgancctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcntccanccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagnaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaagaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaagcacccagtgccccaccccaaggtgtaactgtatccaagaatgatggaaacggaactgcaattctagttagttggcagccacctccagaagacactcaaaatggaatggtccaagagtataaggtttggtgtctgggcaatgaaactcgataccacatcaacaaaacagtggatggttccaccttttccgtggtcattccctttcttgttcctggaatccgatacagtgtggaagtggcagccagcactggggctgggtctggggtaaagagtgagcctcagttcatccagctggatgcccatggaaaccctgtgtcacctgaggaccaagtcagcctcgctcagcagatttcagatgtggtgaagcagccggccttcatagcaggtattggagcagcctgttggatcatcctcatggtcttcagcatctggctttatcgacaccgcaagaagagaaacggacttactagtacctacgcgggtatcagaaaagtcccgtcttttaccttcacaccaacagtaacttaccagagaggaggcgaagctgtcagcagtggagggaggcctggacttctcaacatcagtgaacctgccgcgcagccatggctggcagacacgtggcctaatactggcaacaaccacaatgactgctccatcagctgctgcacggcaggcaatggaaacagcgacagcaacctcactacctacagtcgcccagctgattgtatagcaaattataacaaccaactggataacaaacaaacaaatctgatgctccctgagtcaactgtttatggtgatgtggaccttagtaacaaaatcaatgagatgaaaaccttcaatagcccaaatctgaaggatgggcgttttgtcaatccatcagggcagcctactccttacgccaccactcagctcatccagtcaaacctcagcaacaacatgaacaatggcagcggggactctggcgagaagcactggaaaccactgggacagcagaaacaagaagtggcaccagttcagtacaacatcgtggagcaaaacaagctgaacaaagattatcgagcaaatgacacagttcctccaactatcccatacaaccaatcatacgaccagaacacaggaggatcctacaacagctcagaccggggcagtagtacatctgggagtcaggggcacaagaaaggggcaagaacacccaaggtaccaaaacagggtggcatgaactgggcagacctgcttcctcctcccccagcacatcctcctccacacagcaatagcgaagagtacaacatttctgtagatgaaagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctgactccctccccacaggaagaactccagcccatgttacaggattgtccagaggagactggccacatgcagcaccagcccgacaggagacggcagcctgtgagtcctcctccancaccacggccgatctcccctccacatacctatggctacatttcaggacccctggtctcagatatggatacggatgcgccagaagaggaagaagacgaagccgacatggaggtagccaagatgcaaaccngaaggcttttgttacgtgggcttgagcagacacctgcctccagtgttggggacctggagagctctgtcacggggtccatgatcaacggctggggctcagcctcagaggaggacaacatttccagcggacgctccagtgttagttcttcggacggctcctttttcactgatgctgactttgcccaggcagtcgcagcagcggcagagtatgctggtctgaaagtagcacgacggcaaatgcaggatgctgctggccgtcgacattttcatgcgtctcagtgccctaggcccacaagtcccgtgtctacagacagcaacatgagtgccgccgtaatgcagaaaaccagaccagccaagaaactgaaacaccagccaggacatctgcgcagagaaacctacacagatgatcttccaccacctcctgtgccgccacctgctataaagtcacctactgcccaatccaagacacagctggaagtacgacctgtagtggtgccaaaactcccttctatggatgcaagaacagacagatcatcagacagaaaaggaagcagttacaaggggagagaagtgttggatggaagacaggttgttgacatgcgaacaaatccaggtgatcccagagaagcacaggaacagcaaaatgacgggaaaggacgtggaaacaaggcagcaaaacgagaccttccaccagcaaagactcatctcatccaagaggatattctaccttattgtagacctacttttccaacatcaaataatcccagagatcccagttcctcaagctcaatgtcatcaagaggatcaggaagcagacaaagagaacaagcaaatgtaggtcgaagaaatattgcagaaatgcaggtacttggaggatatgaaagaggagaagataataatgaagaattagaggaaacntgaaagctgaagacaaccaagaggcttatgagatctaatgtgaaaatcatcactcaagatgcctcctgtcagatgacacatgacgccagataaaatgttcagtgcaatcagagtgtacaaattgtcgtttttatncctcttattgggatatcattttaaaaactttattgggtttttattgttgttgtttgatccctaaccctacaaagagccttcctattcccctcgctgttggagcaaaccattataccttacttccagcaagcaaagtgctttgacttcttgcttcagtcatcagccagcaagagggaacaaaactgttcttttgcattttgccgctgagatatggcattgcactgcttatatgccaagctaatttatagcaagatattgatcaaatatagaaagttgatattcaacctcacaagggctctcaaagtataatctttctatagccaactgctaatgcaaattaaaacatatttcattttaacatgatttcaaaatcagtttttcatactaccctttgctggaagaaactaaaaatatagcaaatgcagaaccacaaacaattcgaatggggtagaaacattgtaaatatttactctttgcaaaccctggtggtattttattttggcttcatttcaatcattgaagtatattcttattggaaatgtacttttggataagtagggctaagccagttggatctctggttgtctagtcattgtcataagtaaacctagtaaaaccttgttctatttttcaatcatcaaaaagtaattataaatacgtattacaaacaagtggatgtttttaatgaccaattgagtaagaacatccctgtcttaactggccntaaattncttctggtagtgtcagttcaactttcagaagtgccacttaaggaagtttgatttttnnttttgtaangcacngnttttaanctctctctcntttttttttttttttnggttttaaaagcacaatcactaaactttatttgtaaaccattgtaactattaaccttttttgtcttattgaaaaaaaaantgttgagaagcgtttttaacctgttttgttaatgctctatgtttgtatttggaatatttgaataatgacagatggtgaagtaacatgcatactttattgtgggccatgaaccaaatggttcttacttttcctggacttaaagaaaaaaagaggtttaagtttgttgtggccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaagaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagttccatagaaaaggcgtgcagtactaagggaacaatccatgtgattaatgttttcattatgttcatgtaagaagccccttatttttagccataattttgcatactgaaaatccaataatcagaaaagtaattttgtcacattatttattaaaaatgttctcaaatacaaannnaaaaaaaaaaaaaaaaaaaaaaaaaaaaaaaaaaaaaaaaaaaaaaaaaa

SEQ ID NO: 200 - DNA, 1009 bp, Homo sapiens
  modified_base (5)..(5): a, c, g, or t
  modified_base (141)..(144): a, c, g, or t
  modified_base (146)..(152): a, c, g, or t
  modified_base (989)..(992): a, c, g, or t
tgctngaatggaatctaatgcctcatgatctgaggttgaatagcttcgtgccgaaaccatcccccacccccatcccgctaccccgagtccgtgaaaaaattgtcttccatgaagccggtccctggtaccagaaaggttggnnnncnnnnnnntaaaataccaataaatttttgaaccttaaaaactttgaagaacaaggtaaattggtgttttatttaatgtcctaccctttaatttgttgcattttcctatactctttacactattttatcccaaactatgtatatgaggtgaaaatatatatgaaaagggatactgaagaatatttagtttaaaattaatttcttacgatcacgagcacatggtggcataattacaaagcttggaagtattcaaatagaaaatcaaaggtgtttcaatacagtagaatcccaggactgcattttaaaatcgcctcacagatcacactcgctggtggcaaatatcatcatcgttgctaaaggacagaaaatactgatgtgtgttttaactaactggtatattgatccatgggaggctgcacagaagaccctgcggccaggaggggcattgtcagtggctgcttctcctgagctccacgccttcattgcagctgcatgttcgatacaatacacctgcttcacagccccatggacatccctacaggtactgtcatgtgaagccttgcctagtagttctctccagggcaaatgaagctcacagttttgcaaggtggaaacctcttattcacatttgctttgattccccgatggagtagactgcctttgttccatacaggcaaagtaaggatattttaatatcatcctacttcttattagcatttcatttgtctatgtactgtatttcatttgtatgtctcctgaaacatccaaatagagaacataagaacactttatgtacaatctggaaaaaaattacctgagaaatcaattaaagatttttcccctttnnnnaaaaaaaaaaaaaaaaa

SEQ ID NO: 201 - DNA, 1565 bp, Homo sapiens
  modified_base (372)..(375): a, c, g, or t
  modified_base (378)..(378): a, c, g, or t
  modified_base (513)..(513): a, c, g, or t
  modified_base (551)..(551): a, c, g, or t
  modified_base (1155)..(1155): a, c, g, or t
cactgttaagacctcctattgagttttccaggtcctcagatgggaattgcacagtaggatgtggaacctgtttaatgttatgaggacgtgtctgttatttcctaatcaaaaaggtctcaccacataccatgtggatgcagcacctctcaggattgctaggagctcccctgtttgcatgagaaaagtagtcccccaaattaacatcagtgtctgtttcagaatctctctactcagatgaccccagaaactgaaccaacagaagcagacttttcagaagatggtgaagacagaaacccagtaacttgcaaaaagtagacttggtgtgaagactcacttctcagctgaaattatatatatacacatatatatatnnnnttnacatctgggatcatgatagacttgttagggcttcaaggccctcagagatgatcagtccaactgaacgaccttacaaatgaggaaaccaagataaatgagctgccagaatcaggtttccaatcaacagcagtgagntgggattggacagtagaatttcaatgtccagtgagtgnggttcttgtaccacttcatcaaaatcatggatcttggctgggtgcggtgcctcatgcctgtaatcctagcactttgggaggctgaggcaggcaatcacttgaggtcaggagttcgagaccagcctggccatcatggcgaaacctcatctctactaaaaatacaaaagttaaccaggtgtgtggtgcacgtttgtaatcccagttactcaggaggctgaggcacaagaattgagtatcactttaactcaggaggcagaggttgcagtgagccgagattgcaccactgcactccagcttgggtgataaaataaaataaaatagtcgtgaatcttgttcaaaatgcagattcctcagattcaataatgagagctcagactgggaacagggcccaggaatctgtgtggtacaaacctgcatggtgtttatgcacacagagatttgagaaccattgttctgaatgctgcttccatttgacaaagtgccgtgataatttttgaaaagagaagcaaacaatggtgtctcttttatgttcagcttataatgaaatctgtttgttgacttattaggactttgaattatttctttattaaccctctgagttttngtatgtattattattaaagaaaaatgcaatcaggattttaaacatgtaaatacaaattttgtataacttttgatgacttcagtgaaattttcaggtagtctgagtaatagattgttttgccacttagaatagcatttgccacttagtattttaaaaaataattgttggagtatttattgtcagttttgttcacttgttatctaatacaaaattataaagccttcagagggtttggaccacatctctttggaaaatagtttgcaacatatttaagagatacttgatgccaaaatgactttatacaacgattgtatttgtgacttttaaaaataattattttattgtgtaattgatttataaataacaaaattttttttacaacttaaaaaaaaaaaaaaaaaaaaaaaaaa

SEQ ID NO: 202 - DNA, 829 bp, Homo sapiens
  modified_base (100)..(100): a, c, g, or t
  modified_base (102)..(102): a, c, g, or t
  modified_base (104)..(104): a, c, g, or t
  modified_base (604)..(604): a, c, g, or t
  modified_base (694)..(696): a, c, g, or t
  modified_base (741)..(741): a, c, g, or t
  modified_base (764)..(764): a, c, g, or t
  modified_base (768)..(768): a, c, g, or t
aggtcctttgtgtttcgacagtatttattaatgcagatatcagtgctacagctataaaatataccctgagcagcttgttaattctataaatgacaaagantntntttttaaaaagtcacaattttataaaaatggtttttcttacattcttttgagaactgtttcactcatacatacacccacacaccccactcaaccttgtatcaaattccaaaagtgtaactaaagtataagaatatcatgactagttaaaagatagcaaataccataaggtacaagttcaagtattagtataacaagtatctgagtaacaaatgtccttggaaatggggggtaggaggagatatgattagtcacaggtttggttaactgccctcaaaatttacaagttaaaatgttttggctggtgagcacatttcagttcttaggggaaaaaaagcttttaatggcaatttatagaaatcagaatccaggctaatgatttttatccttcacacagtaaatgcagcccatccagaatcctggagcaataaagtaagaagtaattcaaatatctgcttgtgggtcaataaaaagggtttctgaagtatcaagtcttgtgggnacagcccccaaccctaagggcaggtagtattctatctcctggctggctcatcacattcaaaacaacctgttttttttgttgttgttgttnnngttaagaaatatctcaccctcttattcaatagtgtttgaaaacanggcaatctttgtattttaaatantctnggtttgtagatagtgaattttttttttttttttttttttttttgaggcagagtctcactct

SEQ ID NO: 203 - DNA, 1844 bp, Homo sapiens
  modified_base (13)..(15): a, c, g, or t
  modified_base (51)..(51): a, c, g, or t
  modified_base (58)..(58): a, c, g, or t
  modified_base (60)..(61): a, c, g, or t
  modified_base (63)..(63): a, c, g, or t
  modified_base (72)..(74): a, c, g, or t
  modified_base (78)..(78): a, c, g, or t
  modified_base (87)..(90): a, c, g, or t
  modified_base (93)..(93): a, c, g, or t
  modified_base (95)..(95): a, c, g, or t
  modified_base (390)..(390): a, c, g, or t
  modified_base (415)..(415): a, c, g, or t
  modified_base (1024)..(1025): a, c, g, or t
  modified_base (1035)..(1036): a, c, g, or t
  modified_base (1039)..(1039): a, c, g, or t
  modified_base (1048)..(1050): a, c, g, or t
  modified_base (1054)..(1055): a, c, g, or t
  modified_base (1293)..(1293): a, c, g, or t
  modified_base (1320)..(1320): a, c, g, or t
  modified_base (1326)..(1326): a, c, g, or t
  modified_base (1372)..(1372): a, c, g, or t
  modified_base (1380)..(1380): a, c, g, or t
  modified_base (1386)..(1386): a, c, g, or t
  modified_base (1466)..(1466): a, c, g, or t
tggagcctggcgnnnagtgggggcgtgcgacggttactctggttactgggnccgcgcngnncntggcgagannngccngcccgcgannnntgncntggtgaggaagccgtcgggagccgccgccgccatctgagggaggtaccctggaaaccaccttttatcggtggggaagtgcagtcgcggtgggcggctctgggggccagcgaaacgggaggcctctaaatctttaggttggggctgcattgccctggagccgcactcttgagtccgaggccatcttttgttggagaaggcgtcggcgttggcgttttcccgaggttgggctgtacagtgtctccgtccgcggaaaaagaagcctctgaacccgcgccggcccgcagcccccgtgcnttccggccgctgctcgccgtcgccnagaggctaggccacgtttcccccagtgccgaggtgtttctgtgaccctccctccactcccattcccttctgaaagggcacctgctcttggtgagaaaagaaattatagcacgaagagccagtatcagaagagtatccatcacccgcagcaaccgctcagggaacaccatcaaaaaagaaaaaaagggaatatctggatttcctgggcgaggaggagcgagtctgctcgggagctgttccagcaggcgatttttaaatactgctttctacgccctatacaacttggcttcacatacttttacactaactttatatgatttttaaaaactggtctgatcggacttctcgtcctgggacactgtttactggagtctggccggctctccgtgctcctcttggtacctcattttggggagaaccttaaacccactcgagcagataatctccgccttgaccggtgccaccaaagaagccttggaaccatgtggacttttctgggcattgccactttcacctatttttataagaagttcggggacttcatcactttggccaacagggaggtcctgttgtgcgtgctggtgttcctctcgctgggcctggtgctctnnctaccgctgnncgncaccgaaannngggnntcctcgggcgccagcagagcggctcccagttcgccctcttctcggatattctctcaggcctgcctttcattggcttcttctgggccaaatccccccctgaatcagaaaataaggagcagctcgaggccaggaggcgcagaaaaggaaccaatatttcagaaacaagcttaataggaacagctgcctgtacatcaacatcttctcagaatgacccagaagttatcatcgtgggagctgncgtgcttggctctgctttggcagctgngctttncagagatggaagaaaggtgacagtcattgagagagacttaaaagangcctgacngaatanttggagaattcctgcagccgggtggttatcatgttctcaaagaccttggtcttggagatacagtggaaggtcttgatgcncaggttgtaaatggttacatgattcatgatcaggaaagcaaatcagaggttcagattccttaccctctgtcagaaaacaatcaagtgcagagtggaagagctttccatcacggaagattcatcatgagtctccggaaagcagctatggcagagcccaatgcaaagtttattgaaggtgttgtgttacagttattagaggaagatgatgttgtgatgggagttcagtacaaggataaagagacctccaagttcaggaaaagcctggtctccaataaagtttctgtatcatctcattttgttggctttcttatgaagaatgcaccacagtttaaagcaaatcatgctgaacttattttagctaacccgagacgagttctc

SEQ ID NO: 204 - DNA, 521 bp, Homo sapiens
  modified_base (148)..(148): a, c, g, or t
  modified_base (156)..(156): a, c, g, or t
  modified_base (159)..(159): a, c, g, or t
  modified_base (161)..(161): a, c, g, or t
  modified_base (165)..(165): a, c, g, or t
  modified_base (167)..(168): a, c, g, or t
  modified_base (172)..(173): a, c, g, or t
  modified_base (175)..(175): a, c, g, or t
  modified_base (283)..(283): a, c, g, or t
  modified_base (437)..(438): a, c, g, or t
  modified_base (494)..(494): a, c, g, or t
tttttttttgggtttccccaccccctcaatctgtcggggagcccctgcccttcacctagctcccttggccaggagcgagcgaagctgtggccttggtgaagctgccctcctcttctcccctcacactacagccctggtgggggagaanggggtggntgntncttntnntttnntnttttttttttttttttttttaattcaatctggaatcagaaagcggtggattctggcaaatggtccttgtgccctccccactcatccctggtctggtcccctgttgccnatagccctttaccctgagcaccaccccaacagactggggaccagccccctcgcctgcctgtgtctctccccaaacccctttagatggggagggaagaggaggagaggggaggggacctgccccctcctcaggcatctgggagggccctgccccnntgggctttacccttccctgcgggctctctccccgacacatttgttaaaatcaaacnctgaataaaactacaagtttaatatga

SEQ ID NO: 205 - DNA, 5187 bp, Homo sapiens
  modified_base (64)..(64): a, c, g, or t
  modified_base (66)..(66): a, c, g, or t
  modified_base (69)..(71): a, c, g, or t
  modified_base (74)..(74): a, c, g, or t
  modified_base (89)..(89): a, c, g, or t
  modified_base (522)..(522): a, c, g, or t
  modified_base (597)..(597): a, c, g, or t
  modified_base (668)..(669): a, c, g, or t
  modified_base (741)..(741): a, c, g, or t
  modified_base (920)..(920): a, c, g, or t
  modified_base (1112)..(1114): a, c, g, or t
  modified_base (1339)..(1339): a, c, g, or t
  modified_base (1458)..(1459): a, c, g, or t
  modified_base (1462)..(1464): a, c, g, or t
  modified_base (1591)..(1591): a, c, g, or t
  modified_base (2547)..(2547): a, c, g, or t
  modified_base (2554)..(2554): a, c, g, or t
  modified_base (2648)..(2648): a, c, g, or t
  modified_base (2795)..(2795): a, c, g, or t
  modified_base (2848)..(2849): a, c, g, or t
  modified_base (2851)..(2852): a, c, g, or t
  modified_base (3716)..(3716): a, c, g, or t
  modified_base (3728)..(3728): a, c, g, or t
  modified_base (3733)..(3733): a, c, g, or t
  modified_base (3873)..(3873): a, c, g, or t
  modified_base (4021)..(4021): a, c, g, or t
  modified_base (5115)..(5115): a, c, g, or t
  modified_base (5122)..(5123): a, c, g, or t
  modified_base (5125)..(5125): a, c, g, or t
  modified_base (5128)..(5129): a, c, g, or t
ttaaatatggtacaaatatattctcaaaactctgtcatctcagttctttttttttttccttttncnatnnngtnttttctttctttttnttttttttttttttaatgtcctagcttggtttggtcttgaaaagattcataatcactccaaatgaaatgctcctcccttggccaccaatgtgaagggagggtagaaacctgaggctagacttctgacacaagaagaatctgtcgagagcacagtctcccagtcaataagaaggaaggagagagggggatgagctcgcacccttgagaagaaccttcatgagccaattcccaaagcatcaactccgcatggatactttgcacacacatcagccgtgtctaatggacacacacacgtgcatacacacgtgagcacacgccgggaccacagacccttatccaaaatatgaaagcagcagctattggtcaatttgaggaactcattttgtaaagaaaaaaaaaatccttcagcctggatgagagaaaaaaaaaaaanccaaaaaaaccatcttgaagctcaacctgtaaaacttgaaattctcctggaacagggctgggtgtttttgttttnttttttctttcgaacttttgttccacaaacaggaagttttgtcttttatactgaagctcagacaccagcannaaaaaaaaaaaaaaaaaaaagaatttgtaaaaacaggtgctttctttccatctgctgggggcgggtgggggnaacgaaaaaacacaaaatcctggtttgaaaccgtcgttgccccaaaggagcagcaactgtggaaaccccttgccctccaggttcacagttaaatcctctgcaggactagttaaattggtaaccaaacgagtccaccttaagatgaacagaaatgtataggaacgatctctgaactccantggacatggtagagtcgtgagaatcctgagttttccagaggctttcaaaccagaggaaagcgaaaatgggaacccctgcccgcccccgccacggtaggcactgttaggaaggattggaccgaggcaaggtcagaatccgcccgtttttcttgcctccgttcatgtgtgtgtaagggatgtgttcctcgtagnnncgcttgaaacccagcgaggaccctccatcccggccccccgcctcctccctctgacagtgcgaggaacggtccaggggcacattctccatgtcctcaaactccatctccagctcctcactctcgggagccttgttctcctcgctgtggaagaacgacacctctggaaagctggggtgcaggtcgtccttgagcaggttgacaatctccaggaaggttggcctcatnttggggttgaattgccagcacatgcgcatgaggtcagtgactctctctggacagttgtcgggttgatccagataccctccatccatgacaaatttcaacacctgttcattagacaggcnntgnnnaggctgttctgccaagctggtgatttcccaaaggaccacgccaaaggaccacatgtcagaagaagtggtgaagaccccatccttcagggactccggtgccatccaccgtacagggagcagacccttnccccctttccggtagtaatccgtttcatagatgtctctggtcattccaaagtctccaattttgacagtaaaatcatgggcgaccatgcagtttctcgctgccaggtcccgatgcacaaacttcttggcgttcaggtaggccatcccgtcagcaatctctgccgccatctgaatcatctcttgaagggtagggggagggcggccaggattattctcagcctctggccgcagagaacggaggtagctcttcaggtctccgtgagccatcagctccatcaccaccagcgtgggctggcccttggacaccactcccaggaggcgcaccacgtgatggcaggtgaagcccttcatgaccgaggcctcattgaggaactcaatccgctctcggagactggctgactcgttgaccgtcttcaccgccacgcgggtctctgcctcacccttgatgatgtccctggcattgccctcatacaccatgccgaaggagccctgccccagctctcgaaggagggtgatcttctctcgagacacctcccactcgtccggcacgtacacagagcatggaaacacatcactggcactgagatactcagggtttgaagaagcgtaaagcggtcccagcggcccatctggctgcctctttctcaggaatagataaatacttccaatcacaacactgaagagaaagacaaagatgagggggccgatgataatttttgcaatatttgacgggacgtctaaatagtctgtcacgtagaaataggtgggttccgtccaagagccgttgcccgcaagggaggtggcccggattcgcacgctgtagttccccggtgacagcccacgcagcctgcagccccgttccagagcgaagtgcttgcgggagacgcagagatgcagctcctcatcaccatatcgccgataactcacttcatacagcacgatcagaccattgggctncttcggntcctgccacatcaagtggacgacgttgttctcaaagatttcatgcgtcacagggccaacaatgtcatcagccttggcttcaggcatggtcctcngcactgacgtaggctgccacactgcaccgttcctcaggggtgtcctggttgcaagcctgcagctcgatgcgatagcccgtgaagtgtcgcaagccggagatgaccagcgactccttgttcaccaccttctcaaaaggcctgtgctcntccggactcgtgggcacgctggtcgaggaagtgttggggaaagctgccaccgnngnnacggccaccgtcacattcccaacatcgccaagggacctgcgtttccgagatggcctggggacgaaaaccacgttgtgcaggtaatcctcaaacgtcttcctaaacgaggactcctccagctccttcaggatctgagagtctgtctttggacaggagcagcattcgccggccgaatcctcatactcactctggttgtgcttctgagaatcttcagactcgaatggtggagaccaggtcctcgagggcagcttcagccctttgaggcaataatccagctcgaacagctcactgtcttccgcctgcctctcccagaaaaccaggtagtgggtgatgttgccattggggtcggagggtggtttccacttcagaataatctgggatgatgagttagacactgagattggatccaggggcacagaggggttggtggcatctgtctggacataaatgatgtcactcttggccccataggtccggcgttcatccgaaaaggtgaccagggtcttcacaaagatggcatactgggtccagggcttgagaccccgcatcagccaccctgggtggttctgtgatttggggtcgttggacctcaggggtgggtcaatgtctaccaccgtccaactgttggaaccacatgcatcctgcccgtcgaactccgtcacattctgataaggggcctctttgtagaacagcatgaaccccaagaggtctcggaagtcggggggccagtacggctcccatctcagcaagatcttgtcaaaagatgtccgaatgtaagaaaatttaagtaactcattttcacaggatgcctggtccccattggtcttcagggcaatgtcgtttctctcctggcgccccttggtncctgaaacttcnttccnatcttgtggatttctgacaagcagagtttggggttatagtggaagaagagtttcccctgagtgatggtgaggttgtgtttgctccagtcccagagctgccttaggttctggttgtccaaggcatagaaggagtagttccnaatttccaaggtctctcctcgaatcagacgtaacttccggaagaaggaaagtgacaccagagcgtaggatcggcggatttttagataccctgaaatttcttcaatgaggccgaggttggcttctagctcagctgccagattgttgccncctcgaatgttgatgatcagactcccgttgatgacggtgcatcctcggagctcctgggcagacgtcaccgagtcgatggtcttctcgccttctaggaggtggcacaccttgggacagggacccaggcatggggtgcacagcaagttgctggaattcatcgtgtacccggagggacactcagggatgcacttgttgttgtgaatgacgtactggtggcagccctgcctccgcgagttcttgcatttgtggtgcaggtcctggcagaagctgaagttcacacagcgccagtcctggaagtggtagtacgggggcgggcaggtctccacacacctgccgtccaggtagaagttgcggcaggccacgcacttggtggggtcgtcgggctgagaacagttgcccaggcactcgctgtggcaacagaggccttcggcggtgcagccgtgtgacttacagatggtcgggcaaactttctggcagtgactatgagtccaacatcgttcgacaaactgcccgttgatgacggtggcggggcagttggtcttgcccttcgcggtacccggacagatgtctccacactcctcgttgtcatctttgttcaacacgatgtaattatcctccacggaatccaggatacgggaccagtcgatagtggccaagtaacagagctcattgttcttctcgatgcggacagaaccccgggtgatgttcatcaggttgtagaggccgagttccttgaggtgaaccatctcgaagatgaccagcgcgtagttaaagaacagtcgtgatccccggatgaccgtgaggttggggaacaggtccttcaggctctcgagcccatagacccggaagagcagcaagtaatcagtgatcatgatgagtttggggaaactgaggtctcggaaatcttcgggcctcgttttgaacatcaagagtatctgcaagtgtccttcgatgacagagcaattctccagctcatgcaacctagtgaggttgttccggatatccatgccgggacacacctctccggggtacaggtggcccgcggcgcccagtagcagcgcggccaccgccaccagcagcggcgcggccgccgncccccgnngnccnncggtgcccatggctgcgggagcgcggggtctcctcggatcagagcgcgcgctcccggt

SEQ ID NO: 206 - DNA, 680 bp, Homo sapiens
  modified_base (45)..(45): a, c, g, or t
  modified_base (123)..(123): a, c, g, or t
  modified_base (217)..(217): a, c, g, or t
  modified_base (384)..(384): a, c, g, or t
  modified_base (398)..(398): a, c, g, or t
  modified_base (659)..(659): a, c, g, or t
gggaagcgcgcgtggccgccatggcgcggaatgtggtgtaccccntgtaccggctgggtggcccacaacttcgggtgttccgaaccaacttcttcattcagctggtgcggcccggtgtggccnagcccgaggacaccgtgcagttccggatccccatggaaatgacaagggtggacctcaggaattacctcgagggcatctataacgtgcccgtggntgctgtgcggacacgggtgcagcatggctctaacaagagaagagatcacagaaacgtgaggatcaagaagccggactacaaggtcgcctacgtgcagctggcccatggacagaccttcacgttcccagatctgtttcccgagaaagacgagagccctgaaggcagcnctgccgacgacctntacagcatgctcgaggaggagaggcagcagaggcagagcagcgacccgcggcggggcggcgtccccagctggttcgggctgtgacggggtggccagcagggacgcgccccaggtgggcagctgtggcagagcagcgacccgcggcggggcggcatccccagctggttcgggccgtgacggggcggccagcagggacgcgccccaggtgggcagctgtggcagagcagtcccgacacctaaataaaagtcttgctgcagganaaaaaaaaaaaaaaaaaaaaa

SEQ ID NO: 207 - DNA, 566 bp, Homo sapiens
  modified_base (406)..(412): a, c, g, or t
  modified_base (414)..(429): a, c, g, or t
  modified_base (433)..(435): a, c, g, or t
  modified_base (522)..(526): a, c, g, or t
ctctcggtgactactatcgctgtcatgtctggtcgtggcaagcaaggaggcaaggccgcgccaaggcaagtcgcgctcgtccggctggccttcattccggagcgagtgcatcgttgctgcgaaaggcaactacgcgggcagtgggggccggcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccaggggcgcgtcttgcctaacatccaggccgtactgctccctaagaagacggagagtcaccacaaggcaaagggcaagtgaggcnnnnnnncnnnnnnnnnnnnnnnncggnnncgagaagacgacagaaggggcacctgtgaactcaaaaggctcttttcagagccacccacgttttcaaataaaagagttgttaatgcnnnnnaaaaaaaaaaaaaaaaaaaaaaaaaaagtcgtatcgatgt

SEQ ID NO: 208 - DNA, 153 bp, Homo sapiens; identical to SEQ ID NO: 46
  modified_base (2)..(5): a, c, g, or t
  modified_base (11)..(11): a, c, g, or t
  modified_base (137)..(138): a, c, g, or t

SEQ ID NO: 209 - DNA, 153 bp, Homo sapiens; identical to SEQ ID NO: 46
  modified_base (2)..(5): a, c, g, or t
  modified_base (11)..(11): a, c, g, or t
  modified_base (137)..(138): a, c, g, or t

SEQ ID NO: 210 - DNA, 3135 bp, Homo sapiens
  modified_base (622)..(623): a, c, g, or t
  modified_base (625)..(631): a, c, g, or t
  modified_base (634)..(634): a, c, g, or t
  modified_base (637)..(637): a, c, g, or t
  modified_base (639)..(639): a, c, g, or t
  modified_base (642)..(642): a, c, g, or t
  modified_base (646)..(646): a, c, g, or t
  modified_base (651)..(651): a, c, g, or t
  modified_base (657)..(658): a, c, g, or t
  modified_base (662)..(663): a, c, g, or t
  modified_base (676)..(676): a, c, g, or t
  modified_base (678)..(678): a, c, g, or t
  modified_base (680)..(680): a, c, g, or t
  modified_base (686)..(686): a, c, g, or t
  modified_base (689)..(690): a, c, g, or t
  modified_base (695)..(695): a, c, g, or t
  modified_base (698)..(698): a, c, g, or t
  modified_base (701)..(701): a, c, g, or t
  modified_base (704)..(704): a, c, g, or t
  modified_base (725)..(727): a, c, g, or t
  modified_base (730)..(731): a, c, g, or t
  modified_base (740)..(740): a, c, g, or t
  modified_base (747)..(747): a, c, g, or t
  modified_base (798)..(798): a, c, g, or t
  modified_base (829)..(829): a, c, g, or t
  modified_base (836)..(836): a, c, g, or t
  modified_base (838)..(838): a, c, g, or t
  modified_base (893)..(893): a, c, g, or t
  modified_base (952)..(952): a, c, g, or t
  modified_base (968)..(968): a, c, g, or t
  modified_base (1004)..(1004): a, c, g, or t
  modified_base (1053)..(1053): a, c, g, or t
  modified_base (1072)..(1072): a, c, g, or t
  modified_base (1084)..(1084): a, c, g, or t
  modified_base (1092)..(1092): a, c, g, or t
  modified_base (1198)..(1198): a, c, g, or t
  modified_base (1253)..(1253): a, c, g, or t
  modified_base (1765)..(1765): a, c, g, or t
  modified_base (1782)..(1782): a, c, g, or t
  modified_base (1806)..(1806): a, c, g, or t
  modified_base (1811)..(1811): a, c, g, or t
  modified_base (1859)..(1859): a, c, g, or t
  modified_base (2055)..(2055): a, c, g, or t
  modified_base (2175)..(2175): a, c, g, or t
  modified_base (2178)..(2179): a, c, g, or t
  modified_base (2181)..(2182): a, c, g, or t
  modified_base (2187)..(2187): a, c, g, or t
  modified_base (2190)..(2191): a, c, g, or t
  modified_base (2193)..(2193): a, c, g, or t
  modified_base (2195)..(2195): a, c, g, or t
  modified_base (2197)..(2197): a, c, g, or t
  modified_base (2262)..(2262): a, c, g, or t
  modified_base (2264)..(2264): a, c, g, or t
  modified_base (2300)..(2300): a, c, g, or t
  modified_base (2336)..(2337): a, c, g, or t
  modified_base (2339)..(2339): a, c, g, or t
  modified_base (2354)..(2354): a, c, g, or t
  modified_base (2362)..(2362): a, c, g, or t
  modified_base (2378)..(2378): a, c, g, or t
  modified_base (2387)..(2387): a, c, g, or t
  modified_base (2391)..(2391): a, c, g, or t
  modified_base (2414)..(2414): a, c, g, or t
  modified_base (2425)..(2425): a, c, g, or t
  modified_base (2428)..(2428): a, c, g, or t
  modified_base (2432)..(2432): a, c, g, or t
  modified_base (2438)..(2438): a, c, g, or t
  modified_base (2442)..(2443): a, c, g, or t
  modified_base (2457)..(2457): a, c, g, or t
  modified_base (2459)..(2459): a, c, g, or t
  modified_base (2461)..(2467): a, c, g, or t
  modified_base (2469)..(2469): a, c, g, or t
  modified_base (2474)..(2477): a, c, g, or t
  modified_base (2480)..(2486): a, c, g, or t
tatttccatgcaagtggaagacggtaccgtctccccacatttgagaagactgttttgcatcactctttgctattgaaggaagcagtgatggtgaatttccttctgtttgggttccttgtgtctataacttcctttgtggtaaagccatcaggaagaatagtgggagtggggtatatggtcagggtgctcatatcctgctttagcctagctgcttcttacggagtgcaagggagaactctgagaagcagtatgtaaataccagggagctgattgctgaatattgtggtctcatctgaatattgtggtctcatctaaatattgacaccaggcaatgaagcagaaatagagtatgtgtccctttatgcgtgggtaacttaagcttctgtcatgtgggaagggggaccgaatcttccctgggaggaaggctccaaattctcactacttctgtgttacttgaagggggaagcataaggaacccagtttgaaggcaacattgtgtgccatgaatctgcttattaatcaacatgccttgttaatgtcctctgccctgaacagcccttactcagttctcatttggaaagttattttttggggttacatcctgtttgtttcagaatttaanncnnnnnnnggnggntnacntgangtcangagttnnagannagcctggccaacntngngaaacnccnnctctnctnaanatncaaaaattagccaggtgtggnnncanncgcctgtantcccagntacttgggaggccgaggcaggagaatcgcttgaacctgggaggcagaggtngtagcgagccaagatcacaccattgcactcnagcctgngncaacagagtgagactctgtcaaaatcaaaaaaaccaaaatacaaaaaactccatngttctgagagtttcccctaaattatcggaagacactcacattgaattggtaggacctantagtatagaggagaantggtatgtatgtcagcagtagagttccaatccaaantgcgctatcgcattagaaatacattaccctcccactccccaagttcagnaaattagaagagaatctgnagtttgtaggangggaatanagctgctataaacatttatgtgcaggtttttgtgtagactcgttttcagctcctttgggtaaataccaaggaaccaggttgctggattgtaagttaagagtatgtntagttttggaagaaactgccaaactgttccaacatgactattttgaattcccatngacaatgaataagagttcctgtagctcctcaccctcattagtatttggtgatgtcactcttgcattttagctaatgggtgaatagtggtctcatcgttttaattcccaatcccatagtgatgtggagcaccttttcatatacttaatctgccatccttatatcatcattggtgaggtgtctggattttctgtccagaattttagttctagtggttttcttatttttagaaaggaagtataggaaggaaggtttaatctgtcttaagcctgattatatgaaaatcaagaataggctaggtgtggtggctgacatctgtaatccccgcactttgtgaggctgaagtgggaggactgcttgagcctgggaagtcaagcctgcagtgagccatgactgttgctgcactccagcctgagtgacagagtgagaccctgtctcagaaaaaaaaaaagcaggctcattttaaagttgtttatattttattttttgaaggaaataaagttgaagagatacnaaagggtagtgaagatnctccttcccctcctgtaattcagnctgtntagtttctattctcgcacagccctgttatcagtttctagtgtaagctngcagtgacttttactttatttataagcaagtgttagtgggtgttgtcatttcttttaaaaatataaattatactgtacatgctattttgtattttggcttttctcccacctaaacaccctaaagatcattttctgtcagtatataaaatcttggtgatgccaatacccatcccttagattgtacaagcagcatttngccatgctttatcccatagcctgcctcctgcagtctcatctttttttctatatgcgtgtccaagtaagttgtagacatttttcacttttaatcctttcagcatacatgtcatgggaattngtnntnngtttntgnntntntngtgtttgagacagtcgctctgtcacccaggctggagttacagtgacgtgatcccagctcattacngnctccacctcccagtttcaagcaattctcatgcctcngattcccgagtagctgggattacagatgtgcaccannangcctgactaattttngtattttnagtagagatggggttncatcatgtnggcnaggctggtctggaactcctggcntccagtcattngcntgcntcggcntccnnaagtgctgggattncngnnnnnnncnaccannnncannnnnnnttggagtttttttgagggagatttgcagtaaggtgaataaatgttaagtgtatcatttgatgaggttttttctttttttttttttttttgagatggagtcttgtatcgcccaggctagagtgcagtggcctggtcttggctcactgcaacctccacctcctgggttcaagggagtctcctgcctcagcctcccgagtagctgggattacaggtgtgagccaccatacccagactcatttgatgagttttgatgtaaaagcatgtaactcaaacccctatgtctggaacatctgtattacatctgaattttttcacctagtcaattcctgcacctctctctcctgtcccttcttccctcccctggcagtcagctactgttaggattttgttcactgtagattaattttgcctattctagaacttcatataacggactcacttatgcagtatgtattctgtaagttccttttactcagcatgtttgtatgttcatcagtgtgtttaagctttgttcctttttatggctgagcagtgttctatgtatgaatgccacattttaacgtttcacctgttaggtgaacaactaactggtgaacaatgggctgtttctagtttggggctatcatgaataaagttggtatgaacatgt

SEQ ID NO: 211 - DNA, 1712 bp, Homo sapiens
  modified_base (557)..(557): a, c, g, or t
  modified_base (573)..(573): a, c, g, or t
  modified_base (581)..(581): a, c, g, or t
  modified_base (604)..(604): a, c, g, or t
  modified_base (623)..(623): a, c, g, or t
  modified_base (655)..(655): a, c, g, or t
  modified_base (865)..(865): a, c, g, or t
  modified_base (896)..(896): a, c, g, or t
  modified_base (904)..(904): a, c, g, or t
  modified_base (944)..(944): a, c, g, or t
  modified_base (1380)..(1380): a, c, g, or t
tttcctctccctttgcattaccttttattacctcatgccaggctggaatttgggaaatctgtttctattacaatgtatacattatacattaaataagattatgcacattacaaataaaattatttcaaaattaagaaattacacatagttcaattaaaattaaatttgaaaataattttatttgtgctgttctttagagcaccaacaattcatacacatgatcttcattctcatagccacttaaggtaagtattacctccattttagaggtgaagaaattaaggttcaaaataactaatttggtgatggccacatagtttttaagaacgttgagtctagcccaagagtgactggaattttcagttcacttaccaccattccagcagaatagcagagcaatttcaattttgcagtaaatcagggttaatcatcccagaactgtttgatagcaaaagactaaaacaactcaagtgcctaccaacagtggacaggttacataaaatataatgcatttgcataatgcagtacatgcaactgtgtacaggaagctctgtatngttctcatagggaaangttctccnaagatagattgttatgaaaaggncaagtgcagaaaagtctancacagtctgctacctgacaagaatgaaaaaangtgaagaaaacacgtatcattcattattgactgatatcagcaggaatgaatactgggcagatacacaagaaaaagaaaagtgaccacctgggtaagttgagggatggattctttatatataatctctttacttcaaatagtttgaaccctgtgaatgtaatacttatttaaaaaattaaacacattttgtattcagaagaacttcccctncaataatattctttctcttcattttatcctnccttatcntccccacacatgatgtagaatgtttttaataaaacaattngcggatgcagaatcaatcagtaatgtaggaatcagtaatgccatccatccacttattccttagaattggtaagtttggcaggcacttaggatcctggcatctctctgaaatgagaagcttttgcaacctcagcctccccaagtgctgggattacagatgtgagacaccagatcagcctcagaagacattttcttagtgccttttttccttctacctacaagcagtgaggttagctcttcctttgaaacggtaggggggctctgaaaagagcctttgggtttgatagcgtttccgggagctcagatacctgtcaaatcacttgcccttggccttgtggtgactctcggtcttcttaggcagaagcacggcctggatgttaggaaggacgccgccctgagcaatggtcacccggcctagcagtttgttgagctcctcngtcgttgcggatggccagctgcaagtggcgcgggatgatgcgagtcttcttgttgtcgcgagccgcgttgccggccagctccaggatctcggcggtcaggtactctaacaccgccgccaggtacaccggcgcgcctgccccaacccgctctgcgtagttgcctttacggagcaggcggtgcactcggcccaccgggaactggagaccagcgcgagaagagcgggatttcgctttggcgcgagctttgcctccttgcttaccacgtccagacattgcaatcagacaaaaatcaccaaaaccagcagcctaagctcacgagaaaacaaacaaaa

SEQ ID NO: 212 - DNA, 2192 bp, Homo sapiens
  modified_base (666)..(666): a, c, g, or t
  modified_base (691)..(691): a, c, g, or t
  modified_base (711)..(711): a, c, g, or t
  modified_base (713)..(713): a, c, g, or t
  modified_base (720)..(720): a, c, g, or t
  modified_base (726)..(726): a, c, g, or t
  modified_base (736)..(738): a, c, g, or t
  modified_base (740)..(740): a, c, g, or t
  modified_base (1057)..(1057): a, c, g, or t
  modified_base (1061)..(1061): a, c, g, or t
  modified_base (1063)..(1076): a, c, g, or t
  modified_base (1225)..(1225): a, c, g, or t
  modified_base (1229)..(1229): a, c, g, or t
  modified_base (1234)..(1234): a, c, g, or t
  modified_base (1241)..(1241): a, c, g, or t
  modified_base (1264)..(1264): a, c, g, or t
  modified_base (1267)..(1267): a, c, g, or t
  modified_base (1269)..(1272): a, c, g, or t
  modified_base (1279)..(1279): a, c, g, or t
  modified_base (1284)..(1285): a, c, g, or t
  modified_base (1287)..(1289): a, c, g, or t
  modified_base (1291)..(1291): a, c, g, or t
  modified_base (1296)..(1296): a, c, g, or t
  modified_base (1299)..(1300): a, c, g, or t
  modified_base (1307)..(1307): a, c, g, or t
  modified_base (1310)..(1310): a, c, g, or t
  modified_base (1319)..(1319): a, c, g, or t
  modified_base (1323)..(1325): a, c, g, or t
  modified_base (1615)..(1615): a, c, g, or t
  modified_base (1618)..(1618): a, c, g, or t
  modified_base (1623)..(1623): a, c, g, or t
  modified_base (1627)..(1627): a, c, g, or t
  modified_base (1631)..(1631): a, c, g, or t
  modified_base (1637)..(1637): a, c, g, or t
  modified_base (1643)..(1643): a, c, g, or t
  modified_base (1648)..(1648): a, c, g, or t
  modified_base (1657)..(1657): a, c, g, or t
  modified_base (1660)..(1660): a, c, g, or t
  modified_base (1667)..(1667): a, c, g, or t
tttcagaatactgtataaaattaaatagaatattgtaatagtttaaggttttgcatatattgggttaaatatttctgaaaagcaaaattatttcaagttttcaaatatcttgacatggaacactgcctttgctaggagtcatttctagaaattacttaaaataggagacaagcatcaatcatagggatttcagctttagaactattggaacaaatctaggttagacaaccagcttatattattaagcaagattacatataataatcatctttttttaaaggagagacttttgcaaatattatacagcaatcaaaaggtcttagcttagtgtatcatccttattagaaaccaagatgttgcattttatttcagtgctttctgtagtcatagctaactcttttacctcagcaatttcaatcaaaaagcttctctatcattctatacataaaatgcagacacattagcagtcaacattatgaatgcctttacaggtaaacaaacaaaatcactttattactggattttataaccaattcccattcttttttgtgactattcaggagaatactgggttgaccctaaccaaggatgcaaattggatgctatcaaggtattctgtaatatggaaactggggaaacatgcataagtgccaatcctttgaatgntccacggaaacactggtggacagantctagtgctgagaagaaacncngtttggnttgganagtccatggnnngnggttttcaggtaggaaaggatatacctttttttaaataagtcacctctatatcctttgtattcttcctatatgttcatcacaaagcaaagttactaggttggtacaaacataattgcagtttttgctactgaaagtgatggcatgcaataaaaatattttcacacataaaatactcgtacataaaatatataaacagcccatattacaatatgcatacacatactacatgaatccctcgcgtgcagttacaactgaaatgtttgatctgttttatttgttccctattacagtttagctacggcaatcctgaacttcntgangnnnnnnnnnnnnnncagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggntganggaantagcaanttcacctacacagttctggaggntgntnnnntgcacgntaggnnannntnttctncannataggtnatnaagcagtcngcannntagtttaatcatgcaaattattttgaatagaataaataaaattaataggatgaaataaagatagcatttggtatgaattacatacattgcatctactgattcattgcagggaatgttaaatgcaacaaaatggatcttagcctccagatgaaaaccagttgaaataaaagcatttaaaatttaaatccataatgcaaactttatcagataattgggatagttactatatgttttgaataatacctgtcacattaactcagtttgaaatatctgttttttaaaattttaanggntaacnttcnaatnctctcnatttgnttatngttatttgngancaaaggnaaaactcacttctaatattagcgaatttcattgtgagagacctatcctctttttaataaaccatttataaacctgttagcaatggccggaaccaggcctcctgaggatgcactggtctatagcaattgccctgctgcatttactaagaatccttacaaggcatttgtttaagaatattgtttatcaactaagaagattacagctttgaagtagagcaggtctcatatacatgaataataacatggcacgatgaatgcttctttagagtaaaaaggttttctttaacttgttaagtcagagttgtctaagtaattgtaatgtcatgatcatgtacattttgtccttttttacagaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaac

SEQ ID NO: 213 - DNA, 1197 bp, Homo sapiens
  modified_base (954)..(954): a, c, g, or t
  modified_base (1002)..(1004): a, c, g, or t
  modified_base (1026)..(1029): a, c, g, or t
ctgaagtatttttagttatataagattggaactaccaagcatgtggctcctggtcagtgtaattctaatctcacggatatcctctgttgggggagaagcaacattttgtgattttccaaaaataaaccatggaattctatatgatgaagaaaaatataagccattttcccaggttcctacaggggaagttttctaatactcctgtgaatataattttgtgtctccttcaaaatcattttggactcgcataaactgcacagaagaaggatggtcaccaacaccaaagtgtctcagactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactgacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttatttgagaacaggtgaatcagctgaatttgtgtgtaaacggggatatcngtctttcatcacgttctcacacattgcgaacaacatgttgggatgggnnnctggagtatccaacttgtgcannnngatagaatcaatcataaaatgcacacctttattcagaactttagtattaaatcagttcttaatttcatttttaagtattgttttactcctttttattcatacgtaaaattttggattaatttgtgaaaatgtaattataagctgagaccggtggctctcttcttaaaa

SEQ ID NO: 214 - DNA, 7028 bp, Homo sapiens
ccggacatgaagcgctacctgtgggagcgctacccgggaggcgaagagaagcacagaagaattggttccttccattatgagcaacttgttgaatccagatgccattttctcaaacaatgaaatgagcctgtcagacattgaaatctatggcttcgattatgattacaccttggtgttttattcaaagcacctccacacgctgatatttaatgctgcacgggaccttctcatcaatgaacaccggtatccagcagaaatcaggaagtatgagtatgacccaaattttgcaattcgtggacttcattatgatgtacagcgggcagtattaatgaagatcgatgcttttcattatatccagctgggaactgtctacagaggcctcagtgttgtccctgatgaagaagtcattgaaatgtacgaggggtcccacgtgcccttggagcagatgagtgacttttacggaaagagctctcatggaaacacgatgaagcagttcatggacatcttctccctgcccgagatgaccctcctgtcctgcgtgaatgaatacttcctcaagaacaacatcgactatgagcctgtgcatctgtacaaagatgtcaaggattcaattcgagacgtccacatcaaaggaataatgtacagagcaattgaagcagacattgaaaagtacatctgctatgctgagcagacccgcgcagtgttggccaaactggctgatcatggcaagaagatgtttctcatcaccaatagccccagtagctttgtggacaaagggatgagttatatcgttgggaaagactggagggacctgttcgatgtggtcattgttcaggctgagaagccaaacttctttaatgataagcggaggcctttccgaaagatgaatgagaaaggtgtcttactctgggataaaatccataagttgcagaaaggccagatatacaagcagggtaatttatatgaatttttgaagcttactggatggagaggatccagagtgttgtattttggtgaccatatatacagtgacctggcggatttgaccctaaagcatggctggaggactggtgcaatcatcccagagttgagatctgagctcaaaatcatgaacacggagcaatacattcaaaccatgacctggctgcagaccttgactggcttattggaacagatgcaggttcacagagatgctgagtcacagctggttttgcaggagtggaaaaaggaaaggaaggagatgcgagaaatgaccaagagtttcttcaatgcccagtttggaagcctgttccgcacagaccagaacccaacctacttcctaaggcgcctgtcgcgcttcgctgacatctacatggcgtctctgagctgcctcctgaactatgacgtcagccacactttctacccccggaggactccactgcagcacgaactgcccgcctggtcagaaaggccccccaccttcggaacccctctcctgcaggaggcccaggccaagtagccaagggcaaaaactagaaactgtaactgcccctgattgggcaggcatgatggggttgacttcatgtgggtctgagtgttgcttttggaaaagatacagataagccttttgatatttattttgtaccttacggagaataattctcccaatgattaagacaggagctagcagcccacccctccagcctttccccccatgcagggctgaaaggcaagcttcacattggaactctgattttgcctttttgtttactgaggtcctggaacatcaggtttcctgggataggtagaccacttgatgccatgtctgtattctagcaggtcaagcttgaaaccgttcttgactcctccatggaacatttcctgaacatttacgggctatgcattgggaactgcaggggcacagtgatgggcaaagattagctgcttccagaaggctgatttcgtgggctccacaatggtaaaacgctgctgtgagtggcagagaggttccccaggtgatggccagttcccaaatcatttggtactaaggctttgacattctggcacatcacatcaaatagaacacagcctccctggaaggacttaagtgagaaagaacaagagaagctgcaactcctggacccttttgtcctcagtgtgtggttcctgcgtccttccccagggcaggagagaggagatgagagctctggtcaaaacctgccagctagtggaacagccttctatagagccttctgcaagaaacgagtgggtttgaagaaccaaaacatttgtggtaggtctcccaggagcttgttaaacctggaaacaccacctgagttggtttcatctgctcattggaagaaagaaaatgaaccaggaaaaagcatctttgtcatgaaatgctatgccatgccacccacccagttgaattggaatcctgttaaaacatgagatttaccagaaacagtcctttgtctagatggaaacaaacaagatcctggcttctctctaatgagttaccaactgagaggtgcttggattggccaggggaggaggaagatggccaccacaacttagccatgtccagccttctcttagatttcactcctgtgatgtttgtgcgactatttgggagtttgtatagtttgtttttttttttttgttttgttttgtttttttttagatgtctaagatgggaaagggcgaaggacattgaagctaaggaatagatatgacctagctaaccaagcttttctcatttctttctgttttgttttgttgagatggagttttgctcttattgcccaggctggagtgcagtggcacaatctcagctcactgcaacctctgcctcccgggttcaagcgattctcctgcctcagcctcccaagtagctgggattacaggcatgcactaccacacccagctaattttgtatttctagtagagatggggtttctccatggtggtcaggctggtctcgaactcctgacctcagataatctgcccgccttggcctcccaaattgctgggattacaggtgtgagccaccgcacctggcctgcttttttcatttctttctaggggcaatgcaagtggcatgtattccttttgttggagggaagaatccttaattgcacctggatttgtagtatccttcaatgtaaagtgcatatttactgcactctctgagtgctatgggaatgtctgctgttattagttatggggctgctaatactgttttaattgcatatgctatatcaatacttctgttcagattagcctgatctagtattgctaaaactcattttaagcttttgcggtaacttgtatatattcttaaatctaaaggatggcaggaacatgaggggagcttgtggagagtgcttgcttattcaacatttttattgtgataaatgtatgtaaccatctattgatgaaatccaagtctggcattccatgggctccttgccagatggcagaaacttaatgagttatatagcatcctttgtaatgctgcttgttatagttggaatgtacttgtgatatttggctgtatttaactataatggtgaaggtgaccctttagatccaataaggcttctccccatcttttcttctacattttgttatgaacacagtaaggcacagtagtatgttctttttttggaacagggtaggcattttgtttattgtttgcttgcttctaggtgttttcgccatcagggtgtattggaggctgacacttaatgggtgtgtgttacgcccagaactgctcggtgtcggggttctaaaagaatgcgctggtgttcttggcttcaagtttctgctttggagaagcagattcaggaagtaggtgttgcttaaaaataattcttggtttttatctaatcagatattcattgattacctaccaggtgccagttatagggtgttttgtttactcaagaatgaagtagaactatttttaaaacctgtttccatgagtgttcacgttaggtgacctaagctttgaaggagaaaaacattttctgggtatgaataatgagttttgtaatcaattcccagttagaagaatttcagtctctgggccattgagcttggcagtgttgagatctcccatgtgacagaagcctggcatctgggccaccaaggctcactgactgtgtaccttgcagactgtagacccatgtcgtggcggtaacggggccaaacacagtcattcccatgtgaacgatggaggcacatcccactttattattaatccttgtatatactcagtcaggacagattttaacttgtcgctgtcatgactttttttttttttttttgaggcaaggtctcgctctgttgcccattctggagtgcagtggtgtgatctcggctcactgcaacctcttgcctcccaggttcaagcaattttcgtgcctcagcctcccgagtagctgggactactggtacatgccaccaggcctggccaagttttgtagttttaatagagatggggtttcaccatgttggccaggctggtctcaaactcctagcctcaagtgttctgcccacctcagccttccaaagtgctgggattctgggtgtgagccactgtcatgcctggcctcgtcatgactcttttctctttttttttttttttttttttgagatttagttttgctctttttgcccaggccggagtgcaatggcacgatcttggctcactccaacctccgcctcctgggttcaagtgattctcctgcctcagcctcccgagtagctgggattacaggtgcccaccaccacatccagctaatttttttgtatttttagtagagacggggtttcaccatgttggccaggctggtctcgaactcctgaccttgggtaatccacctgccttggcctcccaaggtgctgggattacaggcatgagccaccgtgcccagcctatcatgactcaactgggatctggcacactgcactgggtgttttgttctctgatgtgcacattgatgaatgcatattggtacaagggaaacgaatctgttttcagccatttaaaaaattgtgttgtaaagcaaacaaaaatagcttgaacatttaaaaattactgtttaatattgtttgactgattttctaagaattatgtgaacaatgatgagtccagggcagcagccatcacaaatatgacagtccagcaaggcccatggaggtccctttggaagggacttgcacagctgattttctttttccagtgttgtttttacgggtgaaacgtggcttttgaaatactttagttgtttggcttagagctcccactttccccctaacatagtgcctgtctgttttttaaaacattttacccttcggcactattttctgctattcccattaatattatgtaacataaaccacttgctactgatttgggcatattacagactacaattactagttgctttgaatgcattggcactcttaattattgcaaaggagaattgaaaagtagtcttgtggtcctagttaatttagctttgggcaaactaagtggcttttcttctgtcctcttctcaaaaggccttttaagcagcagagactgggctaaatactggaactgaattccacttttctgcctgctcatttgctgccaaagaccacttggggctccttgtctagaatgctctaagacgaaatttggccagacacagggttccttgattgttctgttcaactaatagagaacctacattttgccttcttaatatcgactttcttttgtaccaggtttttctttctttcttttttgccttaggagcttagctcaaagttcagctaacctttgacactactagtgtcatttagtaacagtaatctttgacactactagtgtcatttaggagcttagctcaaagttcagctaacctttgacactgctagtgcgttcaagaaagggtagggaatgaagtacccttaatgcagggtcagcaaacttttcctgtaaaaggccagataggaagtatttttggctttttgggctgtttgcttttgctactactactgtgggaatgaccatggtcatggctgtgttccagcacaacttgatttaccaagacaagctgtgggctgtatttggtcctcaggctgtggcttgctagcccctgctctaatggattgtgttggcggcaatggcaagattcccttgctgagaacatgcagatgaataaccttatagctgggatgcagagaggagaaagttctgtaggtaataagtgcactgtattccctctgagctacttcctgggcatagttacatgtatggccagtgtgtgtacttgagccatcaggctcagacacttgttgaatatacctctcattgcattagtttgtaattgtgctagtgctgggtgctgagctcagctgcccggatgacctttccagactgaaggacatactcccctaacagctgggagtgctgctggctggccatttacttccagcccttatgaggagtttcccctgctgaagagccctgcctgccccagatcatacccccttcctgcctgtaacccttaccggctccatatggggtacaaaggtctggcctcctcaccccaacttgggaaaccctctggggccatcccagctccagagccccttgtggggtcagtgagacctcattgtggccacattacagcccagtgcctctccctgacaagcctgtacccagccggctcagcccacagcactgtcctatgaaccttcctgcacgccattctccacctcagtatctgctttcggggaacccaacctgcgacagtgcttctgtgtgttttcagtcctgcaggtttgaactctgactttggagacttttccagttatctcgtggaatgacagattgtgcctgtatgatatcaggcacaattaatgcaaattaggcagacctatttattctagatgtgaatttgctatttattttaaatgttgattttatgtgttatgtgactctgaacttattgccaaataaaagtttgaattgtaaaaaaaaaaaaaaaaaa

SEQ ID NO: 215 - DNA, 2764 bp, Homo sapiens
agacgcgcaagggcgccgatggaggcagactcgccagcgggccccggcgccccagagcccctcgcggagggagcggcggccgagttctccagcctgctgcgcaggataaaaggcaaactcttcacctggaatattttgaaaacaattgccctgggtcagacgttgtccttgtgtatatgtgggacagccatcaccagccagtatttggcagaaagatacaaagtgaacacccccatgcttcagagctttatcaattattgcttgctgttcctaatttatacagtgatgctggcatttcgatcaggcagtgataaccttttagtaatcttgaaaagaaaatggtggaagtacatcctgctgggactagcagatgtggaagctaattatgtgatcgtcagagcctaccagtacacaactctaaccagtgtccagcttttggattgctttgggattcctgtgttgatggctctgtcatggtttattcttcatgcaagatacagagtgatccacttcatcgccgtggctgtctgtctgttgggtgtaggaaccatggttggtgcagacatactagcagggagggaagacaattcagggagtgatgtattgattggtgacatcttggtccttcttggggcttccctctatgccatttcaaatgtttgtgaggaatacatcgtgaagaagctgagcagacaggagtttttaggaatggtgggcctgtttggaacaattatcagtggtatacagctattgattgtggaatataaggatattgccagcattcattgggactggaaaattgccctgctgttcgtggcatttgccctgtgtatgttttgcctgtacagcttcatgccattggtgattaaagtcactagtgccacttccgtcaacctgggcatcctgacagcggacctctacagcctttttgttggactctttctgtttggctataagttttcaggactctacatcctgtccttcactgtcatcatggtggggtttatcctgtactgctccacccctactcgcacggccgagccggctgaaagcagcgtgcctccagtcaccagcattgggattgacaacctggggctgaagctggaggagaacctccaggagacccactctgctgtcttgtagctggagaagatggcgcacccatcccccaccaggataaagcagagcctgctgcctgctgaggggacacttggggaaatagcagactcagaatggacactctacaaccctgggttggatccagtggttaggttttagaaaggaacactgaacaaagttcaaaagtagaaataccaaaatagagcagaaaccaagctaagagtgtgtttctgtgtttgaggaccaatatctgttcgtgttgaggagatgaggtgcagactccacactggggtcttagaggcaccggtgggaaagcaggactggggagagatccaggactgagccagcctcaggccagggcgggaaagcaggctgtccaggctgggcttggtggtcaggaacaggggcagctcacggtggctctggagtacgtttcctctgtcagatgcttcaaggtttttttttttttttttttttgctgaggcagttattgtccacaggcctttgggtacagatgaggcctcggggctgactgcatgtggcagaaaacgggtgggtcagcccttgaaaagtcttgagatataagtgtgagtactatacaagcattaaactggagtgcagtaaacctaggaaccttcccacaattgtttttttgtttgtttgagatgcagagtctagagtgcagtggtgcaagctcagcttactgtaacctctgcctcctggattcaagtgttagtagctgggattacaaaagcatgtggccccacgcccagctaagttttgtatttttagtagacatggggtttcaccatgttgcccaggctggtcttgacctcccgacctcaagtgatctgcctgccccgacctcccaaagtgctgggattacaggcttgagccaccgtgccaggcctgttttgtttgtttttgtagagagatggggtttcgccatgttgcccaggctaatctcaaattcctgagctaaagcgatctgcccacctcggcctccgaaagtgctaggattacagatgtgaaccactgtgcctggcctgtttgtttgtttgtttaaaacatttctccatcactcattccaggtcccagagcaaactctctctgctctcggagcctgtgacactggctatgtgctccacagtttcagtcccaggtcatactctccaacagttttcagagctccatatatatgtagatgccatcctttctaaaaacttctcacgacctcctggaatattcctattgatctcattttatttagcatcagctcaagaaactaagtcttagtgcacagtatcacaacaaagaaaaagctttgtttttataactggtaaaaacaagaaaagattctcatcaaaatgaaaatataaaattaatcatttctcaccaaagagtatgcctgggagcctccagctgttaaaagacaatgctattactacttcttatcaaaaatctgtaatgccctgtgatttttatgatacttcttcaatacaaagtgttaatatgtgtcatcagtataataacaaccaacaaaatgccactttcagaaaactgtatgtaaattttttgtaacaatgtaaaaaagaaatggggagtaagtgttcacatcattaaaaggctttgaattcatggaaat

SEQ ID NO: 216 - DNA, 2279 bp, Homo sapiens
gctgacggggtggcagtgcggcgggttacggcctggtcagaccataatgacttcagcaaataaagcaatcgaattacaactacaagtgaaacaaaatgcagaagaattacaagactttatgcgggatttagaaaactgggaaaaagacattaaacaaaaggatatggaactaagaagacagaatggtgttcctgaagagaatttacctcctattcgaaatgggaattttaggaaaaagaagaaaggcaaagctaaagagtcttccaaaaaaaccagagaggaaaacacaaaaaacaggataaaatcttatgattatgaggcatgggcaaaacttgatgtggaccgtatccttgatgagcttgacaaagacgatagtacccatgagtctctgtctcaagaatcagagtcggaagaagatgggattcatgtagattcacaaaaggctcttgttttaaaagaaaagggcaataaatacttcaaacaaggaaaatatgatgaagcaattgactgctacacaaaaggcatggatgccgatccatataatcccgtgttgccaacgaacagagcgtcagcatattttagactgaaaaaatttgctgttgctgagtctgattgtaatttagcagttgccttgaatagaagttatacaaaggcttattccagacgaggtgctgctcgatttgctttgcaaaaattagaagaggccaaaaaagattatgaaagagtattagaactagaaccaaataactttgaagcaacaaatgaactcaggaaaatcagtcaggctttagcatccaaagaaaactcatatccaaaggaagctgacatagtgattaagtcaacagaaggagagcgaaagcaaattgaagcacaacagaataagcagcaggccatttcagagaaagatcgggggaatggatttttcaaagaggggaaatatgaaagagcaattgaatgctatactcgagggatagcagcagatggtgctaatgcccttcttccagctaacagagctatggcctatctgaagattcagaaatatgaagaagctgaaaaagactgcacacaagccattttattagatggctcatattctaaagcttttgccagaagaggaactgcaagaacatttttgggaaagctaaatgaggcaaaacaagattttgaaactgttttacttctggaacctggaaataagcaagcagtaactgaactctccaaaattaaaaaggaattaattgagaaaggacactgggatgatgtctttcttgattccacacaaagacaaaatgtggtaaaacccattgataatccaccgcatcctggatcaactaaaccactcaagaaggttattattgaagaaactggtaatttgatacagactattgatgtgccagatagcactactgctgctgctccagagaataatcctattaatctagcaaatgtaatagcagccacaggcaccacaagtaagaagaattcaagccaagatgtcctttttcccacaagtgatactccaagagcaaaagtattgaaaatagaagaagtcagtgatacttcatccctgcaacctcaagccagtttgaagcaggatgtatgtcagtcttacagcgagaaaatgcccatagagatagaacaaaaacctgctcagtttgccacaactgttcttcctccaattcctgcaaactcgttccagctcgaatctgatttcagacaattgaaaagttctccagatatgttgtatcagtatttaaagcaaattgaaccatctttgtatcctaagttgtttcagaaaaatctggatccagatgtattcaaccagatcgttaaaattctgcatgacttttacattgagaaagaaaagccattactcatctttgaaatcttacaaagactttctgaactaaaaaggtttgatatggcagtgatgtttatgtcagaaacagagaaaaagattgcacgtgcattatttaatcacatagacaagtcaggattgaaggatagttctgtcgaagaactcaagaaaagatacggtggttgatttccatttttgctgaaataattgtttttgactttcatatgtaaattttttctactgaaagtgttttgctttttaagaaaatgaaattatatagcaggaaaggactatctttgaacataagttaattaactataaggtgaattgtgatttaactagtgagaattgtattcaagtgaactctgtttttctgaaaataaaaatataaacaatgagaaaaaaaaaaaaaaaaaaaaaa

SEQ ID NO: 217 - DNA, 3998 bp, Homo sapiens
ccgggagcccgggcgccctggagtgaggaggaccgggagctggctctggaggctgcggaggcgacgccggagagaacgaagcctcggctgggagcggatctttcgaagatggtttggctgccttggagatttggagatctgatgccacgatgaggactcacacacggggggctcccagtgtgtttttcatatatttgctttgctttgtgtcagcctacatcaccgacgagaacccagaagttatgattcccttcaccaatgccaactacgacagccatcccatgctgtacttctccagggcagaagtggcggagctgcagctcagggctgccagctcgcacgagcacattgcagcccgcctcacggaggctgtgcacacgatgctgtccagccccttggaatacctccctccctgggatcccaaggactacagtgcccgctggaatgaaatttttggaaacaacttgggtgccttggcaatgttctgtgtgctgtatcctgagaacattgaagcccgagacatggccaaagactacatggagaggatggcagcgcagcctagttggttggtgaaagatgctccttgggatgaggtcccgcttgctcactccctggttggttttgccactgcttatgacttcttgtacaactacctgagcaagacacaacaggagaagtttcttgaagtgattgccaatgcctcagggtatatgtatgaaacttcatacaggagaggatggggatttcaatacctgcacaatcatcagcccaccaactgtatggctttgctcacgggaagcctagtcctgatgaatcaaggatatcttcaagaagcctacttatggaccaaacaagttctgaccatcatggagaaatctctggtcttgctcagggaggtgacggatggctccctctatgaaggagttgcgtatggcagctacaccactagatcactcttccaatacatgtttctcgtccagaggcacttcaacatcaaccactttggccatccgtggcttaaacaacactttgcatttatgtatagaaccatcctgccagggtttcaaaggactgtggctattgcggactcaaattacaactggttttatggtccagaaagccaattagtgttccttgataaatttgtcatgcgtaatggcagtggtaactggctagctgaccaaatcagaaggaaccgtgtggtggaaggtccaggaacaccatccaaagggcagcgctggtgcactctgcacacagaatttctctggtatgatggcagcttgaaatcggttcctcctccagactttggcacccctacactgcattattttgaagactggggtgtcgtgacttatggaagtgcactacctgcagaaatcaatagatctttcctttccttcaagtctggaaaactggggggacgtgcaatatatgacattgtccacagaaacaaatacaaagattggatcaaaggatggagaaattttaatgcagggcatgaacatcctgatcaaaactcatttacttttgctcccaatggtgtgcctttcattactgaggctctgtacgggccaaagtacaccttcttcaacaatgttttgatgttttccccagctgtgtcaaagagctgcttttctccctgggtgggtcaggtcacagaagactgctcatcaaaatggtctaaatacaagcatgacctggcagctagttgtcaggggagggtggttgcagcagaggagaaaaatggggtggttttcatccgaggagaaggtgtgggagcttataacccccagctcaacctgaagaatgttcagaggaatctcatcctcctacatccacagctgcttctccttgtagaccaaatacacctgggagaggagagtcccttggagacagcagcgagcttcttccataatgtggatgttccttttgaggagactgtggtagatggtgtccatggggctttcatcaggcagagagatggtctctataaaatgtactggatggacgatactggctacagcgagaaagcaacctttgcctcagtgacatatcctcggggctatccctacaacgggacaaactatgtgaatgtcaccatgcacctccgaagtcccatcaccagggcagcttacctcttcatagggccatctatagatgttcagagcttcactgtccacggagactctcagcaactggatgtgttcatagccaccagcaaacatgcctacgccacatacctgtggacaggtgaggccacaggacagtctgcctttgcacaggtcattgctgatcgtcacaaaattctgtttgaccggaattcagccatcaagagcagcattgtccctgaggtgaaggactatgctgctattgtggaacagaacttgcagcattttaaaccagtgtttcagctgctggagaagcagatactgtcccgagtccggaacacagctagctttaggaagactgctgaacgcctgctgagattttcagataagagacagactgaggaggccattgacaggatttttgccatatcacagcaacagcagcagcaaagcaagtcaaagaaaaaccgaagggcaggcaaacgctataaatttgtggatgctgtccctgatatttttgcacagattgaagtcaatgagaaaaagattagacagaaagctcagattttggcacagaaagaactacccatagatgaagatgaagaaatgaaagaccttttagattttgcagatgtaacatacgagaaacataaaaatgggggcttgattaaaggccggtttggacaggcacggatggtgacaactacacacagcagggccccatcactgtctgcttcctataccaggttgttcctgattctgaacattgctattttctttgtcatgttggcaatgcaactgacttatttccagagggcccagagcctacatggccaaagatgtctttatgcagttcttctcatagatagctgtattttattatggttgtactcttcttgttcccaatcacagtgttagcactgaagctataaattacctggtcattttgtgatcacaagagtctatgcaaaaaaaaaaatttctttaccccagattatcagatttttttccctcagattcattttaacaaattaagggaagatattttgacacaagaaagcaggaacgtggagaaattggagcaggaaaagaaattatcaaagcaatagaaatagcttggtggtcctatggtgtttttggaagtatttggcattgctaattgagcagtccatatagtactacttttagaagaaacaaaaagtctattttttaaagtaatgttttttcttatgagaaaaaggtttagatagaattgggttttattaatattaatttaatgctattagcaatttccatatactatattgtggaaaagactgaagaatacaattctgagaaatataaaaaaattttaatggtatactcatgttgaaagataaatgttgctaagtcctggtatgatggtgtgagcttccttggggaagtacttcttgagttatgtaactaacaggatgttttactacagatctggatggctattcagataacatggcaaaaaatgatagcagaagatcattaaaaacttaaaatatattttattagaaaacatttatctatgaatgaatatttccttgatgctggtctctgcacacatatgcttggttacttgcatgcattcattggttgttcaataagtgagatgattacagataatactgtattttccttatatggaaaaccgttatagacccaataacaactaaacctttcaaaagaaaatattttctattatgaatgttgattttcataccaaagaagatggagagtctaaaatttggatatgattcttatgtttttttaatagaaaaccttcttcaagtttattttcctaaataaacatcataattgtgaaaaaaaaaaaaaaaaaaaaaaaaaaaaaaaaaaaaaaaa

SEQ ID NO: 218 - DNA, 599 bp, Homo sapiens
cgggacgcggatgcagacgcaggcggaggcgctgacggcggggatggccggggtggccacagctgccgcgggggcgtggacacagccgcagctccggccggtggagctcccccagcgcacgcgccaggtccgggcagagacgccgcgtctgccgcagggggtcacgaatgcggccgcacatattcaccctcagcgtgcctttcccgacccccttggaggcggaaatcgcccatgggtccctggcaccagatgccgagccccaccaaagggtggttgggaaggatctcacagtgagtggcaggatcctggtcgtccgctggaaagctgaagactgtcgcctgctccgaatttccgtcatcaactttcttgaccagctttccctggtggtgcggaccatgcagcgctttgggccccccgtttcccgctaagcctggcctgggcaaatggagcgaggtcccactttgcgtctccttgtaggcagtgcgtccatccttccctagggcaggaattcccacagttgctactttcctgggagggcctcatgttttatctggttcttaaatgtttgttactacagaaaataaaactgaggtattatt

SEQ ID NO: 219 - DNA, 2514 bp, Homo sapiens
  modified_base (314)..(314): a, c, g, or t
  modified_base (686)..(686): a, c, g, or t
  modified_base (987)..(987): a, c, g, or t
  modified_base (1173)..(1173): a, c, g, or t
  modified_base (1350)..(1350): a, c, g, or t
  modified_base (1866)..(1866): a, c, g, or t
catacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcatacacnacttcatgggagactgtagggtgtaagaaaaagaattttgcaaaagaaaattcagaaaacaaagagaatagagagaagaggacggctgctgctgaactgtccagcagccctctctctcagctcagcagctccctctctggccaccagaacagcatgacctctgcacatgcgacacgttccacaagcacgccacacactcatgccagcgtggagagcaccgcatcctccgccgccttctcagcagcggcgacctctgctccaagtgccccgtcctcaggggttgtcctgcctgggagcatgagcactgtgagcagcctgtgcctgggggggaccactgtgagcgtccctagcagcagcaccagggccacggcnttggtgacctcaggcaaagcacccccaaacctgcctcaaggggtgcctcccctgctacacaatcagtacctcgtgggccctggaggactgcttcctgcttacccgatttacggttatgatgagctccagatgctgcagtcacggctgccaatggattactatggaattccctttgcagcacccacagcccttgccagccgagatgggaatctagctaataatccatattcaggtgacgtcacaaagtttggccgaggagactctgcatcccctgcacctccaacgaccaccagctcaggcncagcagagccagtctcaggcacagcacacagcccagcagcccttcgtgaatcctgcactgccacctggtatagctacactggtcttccctactacacaggcatgcccagtgccttccagtatggccccaccatgtttgtccctccagcctcagccaagcgacatggggtgaacctcagcactcccncacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcangcaccactggtctacctgatatgactggttctgtctacaataagacacagacttttgacaagcagggatttcatgcagggacgcctccacctttcagcctgccctcggtcttgggctccactgggcccctggctcagggagcggcccctggctatgcacccccaccattcctacacatcttgccagcccaccagcagccccactcacagctgctgcaccaccaccttccgcaggatgcacagagtggctcgggtcagcgcagcagcccagctccctgcagcccaagtctcaagcctccaaacctgcctacggaactctccatactggacaaactaaacccagaagagaggggtgggctggggcaaggcttatcctgggcaggagagaacacacgagcacgtatttgggagcccagtgccctttcctagaattccccgacatgtgtcagccatgcctctgtggggagtctgcctcccagactgggctactgtatgtaatgtatttatgtatgtattngtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatgaaaaaaaaaaaaaaa

SEQ ID NO: 220 - DNA, 2493 bp, Homo sapiens
tgggctaccagtgggctcccatcctagccaacttcctgcacatcatggcagtcatcctgggcatctttggcaccgtgcagtaccgctcccggtacctcatcctgtatgcagcctggctggtgctctgggttggctggaatgcatttatcatctgcttctacttggaggttggacagctgtcccaggaccgggacttcatcatgaccttcaacacatccctgcaccgctcctggtggatggagaatgggccaggctgcctggtgacacctgttctgaactcccgcctggctctggaggaccaccatgtcatctctgtcactggctgcctgcttgactacccctacattgaagccctcagcagcgccctgcagatcttcctggcactgttcggcttcgtgttcgcctgctacgtgagcaaagtgttcctggaggaggaggacagctttgacttcatcggcggctttgactcctacggataccaggcgccccagaagacgtcgcatttacagctgcagcctctgtacacgtcggggtagcctctgccccgcgcccaccccggcgcctcgccctgggctgaccgcagctgccgcgagctcgggccaaggcgcaggcgtgtccccctggtggcccgcgctctcactgcagcctgtgcccaaccccgcgtctgcatctggagatgcggacttggacgtggacttggacttggacttggatttgagcttggctcttcgcagcccggacttcggaggagtggggcggggcgggggaggggcaccacgggttttttgttttttgtttgtttgtttttaatctcagccttggcgtgagctggggccttcctctcttctccagcctctccctttcactcttcgcccagcatcctgcccccctgtccaaaaacagcaggacatcaggcccatcccatcccaccacactcactcaccagctctggggaaagctactgtgaactaggagcaggattcctgggttctaatcgcaggtccatcactgactgtgacgtctagcaaagcccttgccctctctgagcctcggtttccgcacctcaagtaattaatcccttagcaaatggactcttttagacttctcatttaactcaattccctgagctagactgggattaaaattctcattttgcagtacattaaaactgatgcccagagatgtgatttgcttgaggccacacagctagatttttggtggaagtgggccttgaacacagtgtactttctgcagtttctgactgtaaaacccagtgtctgctctctgagttccatttccaagcccccctccatcttggacctatgtggtctccaccatattcacacaccaccaccaccacttgccaatgcctctcttaaagcaatatacccattcgttctcttattgggaactggatggatgaagccccaaattcagccccacccacagagaagccttcctacactcagcctctgtccacccttggcaaatctttcaagctctctcctccaggaaagtggggccccaactcagtcactccacccccttccaggtccctgaggctggttctactgtatccccatcacctccacaactccactcacccctgacggctccatccacctcaccagttggaaggcttgtggtttcagagaggagcaatgctggtcagcgctgcccagactccagtgtttacagatcaccagcatttacaaccaatccaatggccagaagcctcctctaacaagcccagaaggagttctgaaggggcagatgggggtgtgagtagtcggggagtcgggattgccagcaccctcacccttccttgggggcaagtagaggtgagaacactttccccacctccctccacagacactcctgaggacgctgcatcccacgcactgcctggtgcgtccatagagagaggatcaggtctcagcatttcatctgtgaaagaggcatggccctgggttagaaaggagggcaggagacatggaggaactggggggcacccagatggtgcagatggtttgcacacctgagcctgtctgtggtgaccattccgctcctctcccactaccctccaatctatcattccctactctctaaggccaaaatatcctgagcaaggctggcaaccccaccccaccatcccaaatgcaagcagccaggcccaggagttcctctggcccccacaggcatggagctcccagctggtgggtacagcttgagaggggggcagctccctcaggctaagctactgcccttcactgggccagccctgcctccagccctcacctctctcaccccaactctcccccaagcccctttctactcaacgggtgtagccactggtgctttgaagccttttgtttttataagatggtttttgcaaggggaccaggttctcttttcactgggaccttgcaaggaggggagtgctctcctggtttctgtgcaggcgggttgattaaagatggtgttttcttctct

SEQ ID NO: 221 - DNA, 1003 bp, Homo sapiens
tatacacagcccagccagcacccaggtccttccatccttctgctgcacatggggcgcctgacggaagcggcggcagcgggcagcggctctcgggctgcaggctgggcagggtcccctcccacgctcctgccgctgtctcccacgtcccccaggtgcgcggccaccatggcgtccagcgacgaggacggcaccaacggcggcgcctcggaggccggcgaggaccgggaggctcccggcaagcggaggcgcctggggttgttggccaccgcctggctcaccttctacaacatcgccatgaccgcggggtggttggttctagctattgccatggtacgtttttatatggaaaagggaacacacagagggttatataaaagtattcagaagacacttaaatttttccaaacatttgccttgcttgagatagttcactgtttaattggaattgtacctacttctgtgattgtgactggggtccaagtgagctcaagaatctttatggtgtggctcattactcacagtataaaaccaatccagaatgaagagagtgtggtgctttttctggtcgcgtggactgtgacagagatcactcgctattccttctacacattcagccttcttgaccacttgccatacttcattaaatgggccagatataatttttttatcatcttatatcctgttggagttgctggtgaacttcttacaatatacgctgccttgccgtatgtgaagaaaacaggaatgttttcaataagacttcctaacaaatacaatgtctcttttgactactattattttcttcttataaccatggcatcatatatacctttgtttccacaactctattttcatatgttacgtcaaagaagaaaggtgcttcatggagaggtgattgtagaaaaggatgattaaatgatctctgcaaacaaggtgctttttccagaataaccaagattacctgagtccaagttttaataacaagaataaacaactttgtgaa

SEQ ID NO: 222 - DNA, 1724 bp, Homo sapiens
tgcagcctcggccccgcgggcgcccgccgcgcacccgaggagatgaggctccgcaatggcaccttcctgacgctgctgctcttctgcctgtgcgccttcctctcgctgtcctggtacgcggcactcagcggccagaaaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacagaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagtgtcggtggtgatgggcatcccgagcgtgcggcgcgaggtgcactcgtacctgactgacactctgcactcgctcatctccgagctgagcccgcaggagaaggaggactcggtcatcgtggtgctgatcgccgagactgactcacagtacacttcggcagtgacagagaacatcaaggccttgttccccacggagatccattctgggctcctggaggtcatctcaccctccccccacttctaccctgacttctcccgcctccgagagtcctttggggaccccaaggagagagtcaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcctggagttctcccagctgggcttcattggtaagatgttcaagtcgctggacctgagcctgattgtagagttcattctcatgttctaccgggacaagcccatcgactggctcctggaccatattctgtgggtgaaagtctgcaaccccgagaaggatgcgaagcactgtgaccggcagaaagccaacctgcggatccgcttcaaaccgtccctcttccagcacgtgggcactcactcctcgctggctggcaagatccagaaactgaaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggttcttcttccgcagtgggaacatcgagcacccggaggacaagctcttcaacacgtctgtggaggtgctgcccttcgacaaccctcagtcagacaaggaggccctgcaggagggccgcaccgccaccctccggtaccctcggagccccgacggctacctccagatcggctccttctacaagggagtggcagagggagaggtggacccagccttcggccctctggaagcactgcgcctctcgatccagacggactcccctgtgtgggtgattctgagcgagatcttcctgaaaaaggccgactaagctgcgggcttctgagggtaccctgtggccagccc

SEQ ID NO: 223 - DNA, 842 bp, Homo sapiens
gtggtatgtaccttagctgtgaggggggctgctgaaggcatggaggacagtaatgacggctgtgcctccttggatggtggagacctcagaaatggtctgctacacaggcactaggtcagtttcccgcccttagctgaatgcagatggatgctgggagatggatatggtgagatggtgtggggaggatgttagaaagctggaggtgtttatcacttctcaaggagctactgaatatagggggaaaaaaacaacaaaaagacaagcccagggagaaagcaccattaaggatatacctatgccagcttctatagctgcacctgctttattggcaggtcacttgccacaattgcatctgccctctaaactttttaattttcacactgtatcctagacatgaatgcataaaatacagtgtctggcgggataatgcagagaggtaccatcttgattttccccagttacattcacctggtctggtctctgtaagcttagaagagtagaatcactttattttttaaagacttccggccaggcacggtggttcacgcctgtaatgccagcactttgggaggccgaggcgggtggaccacctgaggtcaggagttcaagaccagcctggccgacatggcgaaaccctgtctctactaaaaaaaaatacaaaaagattagctgggtgtggtggtgtgtgcctataatcccagctactcaggaggctgaggcaggagaattcttttaacccaaaaggcggaggttgcagtgagccaagatcacaccactgcactccagcctgggcgacagaatgagactctgtctcaaaaaaaaaaaaaaaaaaaaaaaaaaaa

SEQ ID NO: 224 - DNA, 992 bp, Homo sapiens
agcgtttaaacttaagcttggagttatttccaccatgcccgggcaagaactcaggacgctgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcctgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgaactagtactaagccgaattctgcagatatcc

SEQ ID NO: 225 - DNA, 953 bp, Homo sapiens
agacccagtcaggacacagcatggacatgagagtcctcgctcagctcctggggctcctgctgctctgtttcccaggtgccagatgtgacatccagatgacccagtctccatcctcactgtctgcatctgtcggagacacagtcaccatcacttgtcgggcgagtcaggacattagcaattatttagcctggtttcagcagaaaccagggaaagcccctaagtccctgatctatggtgcatccagtttgcaaagtggggtccaatcaaagttcagcggcagtggatctgggacagatttcactctcaccatcagcagcctgcagcctgaagattttgcaacttattactgccaacagtataaaagttatcctgtcacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagagggagaagtgcccccacctgctcctcagttccagcctgaccccctcccatcctttggcctctgaccctttttccacaggggacctacccctattgcggtcctccagctcatctttcacctcacccccctcctcctccttggctttaattatgctaatgttggaggagaatgaataaataaagtgaatctttgcaaaaaaaaaaaaaaaaaaaaaaaaaaaa

SEQ ID NO: 226 - DNA, 6938 bp, Homo sapiens
  modified_base (297)..(298): a, c, g, or t
  modified_base (300)..(302): a, c, g, or t
  modified_base (305)..(306): a, c, g, or t
  modified_base (308)..(308): a, c, g, or t
  modified_base (310)..(310): a, c, g, or t
  modified_base (312)..(313): a, c, g, or t
  modified_base (601)..(602): a, c, g, or t
  modified_base (1534)..(1534): a, c, g, or t
  modified_base (1589)..(1589): a, c, g, or t
  modified_base (1602)..(1603): a, c, g, or t
  modified_base (3093)..(3093): a, c, g, or t
  modified_base (3095)..(3095): a, c, g, or t
  modified_base (3333)..(3333): a, c, g, or t
  modified_base (3345)..(3345): a, c, g, or t
  modified_base (3370)..(3370): a, c, g, or t
  modified_base (3816)..(3817): a, c, g, or t
  modified_base (3853)..(3853): a, c, g, or t
  modified_base (3911)..(3911): a, c, g, or t
  modified_base (4761)..(4761): a, c, g, or t
  modified_base (4778)..(4778): a, c, g, or t
  modified_base (4813)..(4813): a, c, g, or t
  modified_base (4843)..(4843): a, c, g, or t
  modified_base (4858)..(4858): a, c, g, or t
  modified_base (5147)..(5147): a, c, g, or t
  modified_base (5384)..(5384): a, c, g, or t
  modified_base (6368)..(6368): a, c, g, or t
  modified_base (6393)..(6393): a, c, g, or t
  modified_base (6687)..(6687): a, c, g, or t
  modified_base (6806)..(6806): a, c, g, or t
  modified_base (6808)..(6808): a, c, g, or t
ttttaatggtctgggcaggcttttattggtagcattcccaaaatccaaataagaactgttatttctatagttggaaattgttagtgtttgtgacttaatagtattaccacatatttctgattcatctatatgaacttatataatcttatagtttggacttggaagtcaaacaaaactcacacatgtatttaggcatataaatactcaaatttaagatatacaggtcaaaatataaccagtttaggggaaaatgatgttgtaaactaaatattgagaatgaaactgaaaacaattagnntnnnttnntntntnntacactttgagacatatgttttattattacagtttattcagtcatgaaaaatctattgcttgccctttttatcaataatactactctgacatttttaagggcagaggcagtgataattggtgtcatgttgcctttgtgggtaatgttgtagatagattttcatttataagccagtacatacatgatagaaggtatccgttgtatcttttaaacaaatggcaaacaaagtataccaccacatctccttttcactattggaaatgaaatagatctaatatggtcaaaggnntttttttttttttttttttttgacatgacaaaagcgtgcatttaatttgatgctttgcagagatacatgaccaaagttgtatgcatggcttgtcttttgggatggtcccagctgtttattttaaaagaaaaaaattaaaatagagccaacaaatgcaattaagaaaaaaaaagtattgagacacaaggggacctacatgttctggtctaagaagcatgcaagtattacaaagcattccagatacagtatgacagaggaacagtgaacaagcattggaacgatgctctttctttcagaaacgggaagtctaacagttatgttttcacaatggtagtgattaaaccatctttatttttaaggaattttataggaagaattttagcaccatcattaaaggaaaaataataatacctttttagccctgcctatctccagtcttggaataataacagaagcatagcacctttcagtatctaaaatataaacaagaatagtaagtccatcccagcttctagagatgaggtagctcatgctaagaaatgttgggtcatttttcctatgaaagttcaaaggccaaatggtctaattccaatcatcacatttgattagagtcagctccacaactcagtttctagatctttttcttcattataggcttcaggatgatgagattgtacatgtggaagagtctcaatttagagtccttggacatatgtttgtaaagttctatatgtcaattattttgcattcaatatcttcttaaataagaaagtgtaaatgtattaaatggtatatactagtgtgacttctatcaatattgatagattgatcaagaggagaaagatatctttaaatttgaatgagaaagatgtctaaacttatagtcttttacaaaaatttaagaagtcgaagtaaattcactttgttctccnaaaatgccactgaatatatactatttaaaaattctatttaagacagtgagaaacnttttttttttttnnaagattctccttaaagagtctctattatagttacacaatatcaagacatgcatgtaggtctcgatcacaagttaaacattttaaactcatttttaattgacaatcttggaatgagaggtcacaaaagggcactaatttctatttttcaactgcagccaagcaaaataaacatgtgttgtggctctatataccccactctttaagctacctgccaggaagaagaatttcctcataaatactaagcaactttttcattacactgaaataaattgaagaaaacggagatttatttattcaatcagtttactttctgcaaaggtggtcattgtcattggtcatcttaaacctaaactgttgtattgaaaaatatttaaaatcaattaaaacttgaggattgtaagtaaaataaatattctgaaggataaggaggccaggcacttaagaccatatatacaatgctgatgcaggatcagccattacttcaagagtctcaggatcaacttcaaacagtcaaagttcttgtgaatggcggtggtcattgatggtggtgctcattgtcgatgtgtcttggcttactttacacaaaacaaactggcccaatttcaacgccgaattcctggtctgtgccgccaacatccacaggagcaagatctatgatgggcaagcgtgccacattctgtgttctatattcaaagacagtcttgcccacatttccattccgcttagagcaagtgtcttgaagaacgatataccggaatctaatatttccctctgctttgatatctaagtcatttgcccctttgagaaccacagcttttttgaggttcttagcttgatcgtccatgtatcctacactgtttttacagatgtaagtgatgttctgggaggcttcttttgataaaaggcgcaaaaaagtcatctgagtaatggctgtattaggtgattggtggtctccataagcgaactgagaccctctgttcatatcaagaccataccaaacaggtttattgtcaggagatttactggcccaccaggttttacgtggtacactggatgggtttgctgaaatacatgtttctcctgtttccatgttgcagtaaactttgattgcatcttcaacagatccttggttaggatcaatccagtattcaccactctgctttgcggaatggcaaagctttaggtcatcacacgtgcgggctgggtgctttttcgagccatcggggctgcgcatggtttcaatctgactactgagtgacttcagggtagcatgaacccctgggtccgttttgtttttgtcatcaggagccgcctgatcttcagtaaactcaggaagtggatctggcatgctttcatcatagtgccccatgatatccccaagagcagctgtaaggtggccagggggacccggagggccaggtgggccaggctcaccaggagggccctcaggtcctgcttctcctacactgcctcgtacacctggaggtccnantggcccaagtggcccagggtttccttctttacctgaaggaccaactgggcctggaggacctcttgggccaaatggtccagggattccagcacttccttgttcaccatttggaccaggagggccaggaagaccctgaagaccagtaaagcctctgtggcccttctgacctctgtcgcctcggtctccatgatcacctttgtcaccacgaggtccttggggtccaggtaatccacgtttnccagctcgaccnaggtgtcctataggaccccgagaanccggatctcctctttgtcctgcatctcctggagcacccacagggccaggagttccaggggcaccctgagagcctggcagacctgcaggcccagggtctccacgatcaccacgttctccaacagcaccatcccgtcctggggtaccatcattgccagctggaccttctggtccaggttcccctacaggaccattggagcctgggggccccacaggtccaggtggacctttatctcctgttgcaccagttggtcctacttttcctggtgttcccgctgggcctggtaggccgggcatgcctctctctccacgttgcccaggcatgccaacaattcctctctgcccggtcgttccagctggaccaggggggccatctggaccaggttgcccatcttctcctgggtcccctttgtctcctgggccaccaggggggccagctggtcctcgnnctcccacacgcccatgagagccagggtccccacgangacctggaggtccctccttcccgggttcccctaggggtcccgcaggtcctggagctcnagcagggcctggaggtccaactctgcccgcagaaccaggaaatcctgtagcaccaggcggaccttgggttcctcgaccaccttttagtccaggaacaccattaggaccatgagggccaggggatcctgctaaaccttgtggtccaggagaaccagcatctcccttctgtcctggctctccaggttcaccttttactccaggctgtccgtcagacccctggggtccggcaaaaccaacagctccagttggcccattttcacctcgagaaccaggattgccccgggagccaggaggaccaactaaacctcgaggaccaggttcacccttttctcccagtaggcctgccggacctggagggcccaaaggacctggaagacctcctgcaccatcatttccagctgtgccttcagcacctttttctcctatgccacctctgtcacccttggggccaggagttcctgcaattcctctttctcccggcataccttgaagacctggtgggcctgtatctccaggggtcccagatggacctggactgccttttgggccatcaggaccatgtcctccagccattcccttctcaccagggagtccagttatcccaggttctcctctttccccaggatttcctcgttctcctctaggtcctaacgggccaactgctccgggacctccaggaacaccttgatcacctggttttccaccttctccaggaggacctggaggaccaggatgcccctgaaaacctgtgggccctggaggtccttgttctcctctttcaccacgtagacccggcggcccaggaggaccataaggaccaactttaccatcttttccaggagctcccctntgcccaggaactccagnatttcctgcttctccaggtttcccagggtcaccantgctacctttggggcctggaaggcccatgntcccgggctgccctntgattcctatggagcctggaggacctggacggccatcttcccctggcgcacccaaaggtccaagttttccttcaggaccttgaacaccaggatttcctgtcaaaccccgagcacctggaagcccaggttcccctggacgtcctggatccccctggcttcctttgggtcctgaagaacctacaggaccccgttctccttgagcaccctttggcccaggtaaaccatcagagcctggaaaaccacgattgccaggagcacccctttctcccactggccctggaggaccaantgttcctgggtcacctctgggacctcttttgccttcttcaccgggtgggcctatcggaccctgaataccatgtggccctggttccccttttgggccagcttctcctttgaaacctggatcacccggaaggcccgaattcccctgaggaccagtgctaccctgaggtcctggagatccaggaggccctgctgagccaggaggaccagaggtacccggagagcccgttgggcctttggnaccaggagtaccatcagttcctattgcaccaggaagacctggagagccaactggacctgggggcccagtttcacctctctgcccctgaggaccttcagggcctcgcgcccctgtaggacctgcttctcccttcattccaggatttcctggaaaaccagaagagcctggtatcccaagaggacccattggtccaggttttccaggcataccatgtgcacctcgttgtccaggagcaccctgtggcccaagtctccctctctctcctggcattcccctcggacccagaggacccatggcacccattggaccagtggggccagcttcacccttggaaccaggtgctccaacttcacctttagggccttcaagacctttgtgtcctcggtgacccttcagacctggaagaccaggagccccaggaaatccacgagctcccggagatcctgcaaatcccacttcaccaggatttccatttctgccaggttcaccatcttccccaggtttaccaggagggccctctggtccacgtgaaccaatcggacccattggtccaggatcaccaggttcaccaggaggtcctgtaggtcctgcaccaccttgctgtccttgtaaaccctgtggtccccttgggccaacaggacccacagagccaggcattagtcctacttgactcccaagtccagatttttcatccaacccagccatttgagctgaaaacggcctgctcaagccatcgggtcctgggtgggacggatgtccaggaggtcctggagcaccaggttgaccaggaacacctggttctccatcaattccctgaggtccacgagggccaggtcttccttttggccctcgctctcctcttggtccctgtgatcctggaggtcctgccggtcctggacgaccacgtatgcctgttacaacaggcactaatcctggttctcccttttgtccctttcttcctctaccaaaatttgtattgccacntccaggtgtttgtgaacagacaggncagcattccccagggggcgttacagggtcggcacagtccagcacatcctggcattctatcttgtcacagagaatggctccattgtcacagacacagatctgacaaggggcaggtttccaaatgtccctgtttaagtacatctggccattctgagtgcaggctatttcttcaccatatccttcatcctcgtcttcttcctgggcttttattgagacaaattgccctaataaaacaataagaatgaggagaggtcttgcttccgcccagtttgccatcatgtctaaatattagacntgtgggttctcctgagagtgaaaagtagattctgaggttattgtagcaccatgaagtcagctgtgggctcttctttcagcaccagccccagggcagcctctgcaaaccccctttttcancnccagctccagcacagtctgcgaaaacttttttcaagcgatgcagctttaaataggaagaatgctgcctccacttcttttcctgccccttttcagcttgttcaggctcataaccatccagtgtctgccaag

SEQ ID NO: 227 - DNA, 6938 bp, Homo sapiens; identical to SEQ ID NO: 226
  modified_base (297)..(298): a, c, g, or t
  modified_base (300)..(302): a, c, g, or t
  modified_base (305)..(306): a, c, g, or t
  modified_base (308)..(308): a, c, g, or t
  modified_base (310)..(310): a, c, g, or t
  modified_base (312)..(313): a, c, g, or t
  modified_base (601)..(602): a, c, g, or t
  modified_base (1534)..(1534): a, c, g, or t
  modified_base (1589)..(1589): a, c, g, or t
  modified_base (1602)..(1603): a, c, g, or t
  modified_base (3093)..(3093): a, c, g, or t
  modified_base (3095)..(3095): a, c, g, or t
  modified_base (3333)..(3333): a, c, g, or t
  modified_base (3345)..(3345): a, c, g, or t
  modified_base (3370)..(3370): a, c, g, or t
  modified_base (3816)..(3817): a, c, g, or t
  modified_base (3853)..(3853): a, c, g, or t
  modified_base (3911)..(3911): a, c, g, or t
  modified_base (4761)..(4761): a, c, g, or t
  modified_base (4778)..(4778): a, c, g, or t
  modified_base (4813)..(4813): a, c, g, or t
  modified_base (4843)..(4843): a, c, g, or t
  modified_base (4858)..(4858): a, c, g, or t
  modified_base (5147)..(5147): a, c, g, or t
  modified_base (5384)..(5384): a, c, g, or t
  modified_base (6368)..(6368): a, c, g, or t
  modified_base (6393)..(6393): a, c, g, or t
  modified_base (6687)..(6687): a, c, g, or t
  modified_base (6806)..(6806): a, c, g, or t
  modified_base (6808)..(6808): a, c, g, or t

SEQ ID NO: 228 - DNA, 662 bp, Homo sapiens
  modified_base (440)..(440): a, c, g, or t
  modified_base (514)..(514): a, c, g, or t
  modified_base (540)..(543): a, c, g, or t
  modified_base (587)..(588): a, c, g, or t
tttacaggaacacagatttgatgttttaataaaaatacgatttctacaaaaggtgcttaacacggcccaggacgggctgtccggtggagtcagccgtaggacccctgaaggatttacaaagacagagccggctcaccagcacactcctgccagcaccgggacccactgcgaacaaagacagagccggctccccagcacgctcctgctagccctgggacccactgtgagccactgcggggtgtccttcatttaaaaaaagtctggactgtgacactgcagaaggagtctgaaagcccaattcctgaatccctgcgttagaactgagagttcaggccgggcgcggtggctcatgcctgtaatcccagcactttgggaggctgaggcgggtggatcacctgaggtcaggagttgaagaccagcctgaccaacatgatgaaacnccatctctaataaaaacttgcccgtaatcccagcactttgggaggccgaggtgagtagatcacgaagtcagganatcgagaccatcctggctaacacggnnnnacactgtctctaataaaaatacaaaaaaattagccaggtgtggnngcgggtgcttgtagtcctggctactcgggaggctgaggcaggagaatggcgtgaacccaggaagcggagctggc

SEQ ID NO: 229 - DNA, 4590 bp, Homo sapiens
  modified_base (668)..(668): a, c, g, or t
  modified_base (709)..(709): a, c, g, or t
  modified_base (745)..(745): a, c, g, or t
  modified_base (752)..(752): a, c, g, or t
  modified_base (763)..(763): a, c, g, or t
  modified_base (768)..(768): a, c, g, or t
  modified_base (777)..(777): a, c, g, or t
  modified_base (788)..(788): a, c, g, or t
  modified_base (1097)..(1099): a, c, g, or t
  modified_base (1101)..(1104): a, c, g, or t
  modified_base (1656)..(1656): a, c, g, or t
aacatggtcatttttattaaagtaaaaaataagatagtagtagctctggacatttggaaatgtgtatgtttgtttacaccctgtgaaaagtagacatggtctgcaaaagagccaatctcctaaatatatttctttctctagaaatgttattttgggacaaatgaatgaatccctgttgggaaaaaagaacctgctgcatatcatccatattttattttattattattttttttgagatggagtctcactctgtctcccaggctggagtggagtggcacaatctcggctcactgcaacttctgcctcctgggttcaagcgattctgctgcctcagcatgcccagtagctgggattacaggtgcatgccaccacacccggctaatttttgtattttagtagagacggggtttcactatgttggccatgctggtcttgaactcctgacctcaagtgatccacccgcctcggcttctggaattacaggtgtgagccaccgcacccagccatgatccatactttaatgtgggttctggattgcttcctaggccacgtgtttaacatgccacatgatgatgcaaagcagtgtgccagccttaatggtgtgaaccaggattcccacatgatggcgtcaatgctttccaacctggaccacagccagccttggtctncttgcagtgcctacatgattacatcatttctggataatggncatggggaatgtttgatggacaagcctcagaatccnatacagntcccaggcganctccntggcacctngtacgatgccnaccggcagtgccagtttacatttggggaggactccaaacactgccccgatgcagccagcacatgtagcatcttgtggtgtaccggcacctctggtggggtgctggtgtgtcaaaccaaacacttcccgtgggcggatggcaccagctgtggagaagggaaatggtgtatcaacggcaagtgtgtgaacaaaaccgacagaaagcattttgatgtgagtttttctactgaaacacattcagaattgaaaagaacaaagtgatggtaaaagatatgataccaagttaaacatccccatccgtgtcctctannngnnnngcgagatagcttatttttagaactgattctttgtcccatgtggctttctttgataccctaaaagttctctttagataattctaatgctgatgatttatgtctccatttagacgccttttcatggaagctggggaatgtgggggccttggggagactgttcgagaacgtgcggtggaggagtccagtacacgatgagggaatgtgacaacccagtcccaaagaatggagggaagtactgtgaaggcaaacgagtgcgctacagatcctgtaaccttgaggactgtccagacaataatggaaaaacctttagagaggaacaatgtgaagcacacaacgagttttcaaaagcttcctttgggagtgggcctgcggtggaatggattcccaagtacgctggcgtctcaccaaaggacaggtgcaagctcatctgccaagccaaaggcattggctacttcttcgttttgcagcccaaggtagttcgtttttaccttatttttacctaaaaatcaaggcctgggcttgctaccttttcaaacaatttttgttatactntctttgctttccatattaacatatcttcaatttcaaatttgaactccttttcttttacattaattggcaactgcctgctttgagtttagtgttttcagttatgaatgaagcttaaatctaacacttcacatgcttgcaattgctcgctattactcttttatatgcaaagaaaagctttttggacagtcaagcgctcctctgtgcgactaggcttcacatacagctcatagttagatacattttatattcacacagtaaccagtagttttggaaaatagtctatgcatggtccaaaatacttgttactgggtaactagcagtagcaggtgcaaacagaataatagaagtggtagtctgagtattgattatttttatgtttgaaaacacatattgaactaggaaaagcatcatttcttttgctgttttgctaagggaatacatctggatctgagacagaaaatggaatttaatgtgattgagatgatcgtgtgtcattagcaccataggctatgaaaatattcccaagttgcagattcaatattcagcaagtgatttctgaagcacttactcttgccagatactaattattctaggctctgaagatacagcagtaaacaaagtgacaaacagctctactttcattgaccttagctggaggagacataggtcaatagataaataatttttaaaaatatctaatttcttcagatgtctatacgtagtactgaaaaatatgccaaagtgaagggtaaatgcatgaaatgcataatgtgtagagggtactgtgtttaattagcatggtcaggaaagtagagagaaaatgtttacacttatcattgcagcatctccttcctttgcttgtatgtaacactagacatgtgtccttttttcaggttgtagatggtactccatgtagcccagattccacctctgtctgtgtgcaaggacagtgtgtaaaagctggttgtgatcacatcatagactccaaaaagaagtttgataaatgtggtgtttgcgggggaaatggatctacttgtaaaaaaatatcaggatcagttactagtgcaaaacctggatatcatgatatcatcacaattccaactggagccaccaacatcgaagtgaaacagcggaaccagaggggatccaggaacaatggcagctttcttgccatcaaagctgctgatggcacatatattcttaatggtgactacactttgtccaccttagagcaagacattatgtacaaaggtgttgtcttgaggtacagcggctcctctgcggcattggaaagaattcgcagctttagccctctcaaagagcccttgaccatccaggttcttactgtgggcaatgcccttcgacctaaaattaaatgcacctacttcgtaaagaagaagaaggaatctttcaatgctatccccactttttcagcatgggtcattgaagagtggggcgaatgttctaagtcatgtgaattgggttggcagagaagactggtagaatgccgagacattaatggacagcctgcttcagagtgtgcaaaggaagtgaagccagccagcaccagaccttgtgcagaccatccctgcccccagtggcagctgggggagtggtcatcatgttctaagacctgtgggaagggttaaaaaaaagaagcttgaagtgtctgtcccttgatggaggggtgttatctcatgagagctgtgatcctttaaagaaacctaaacatttcatagacttttgcacaatggcagaatgcagttaagtggtttaagtggtgttagctttgagggcaaggcaaagagaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatatagcataataaagccccgggcattattattattatttcttttgttacatctattacaagtttagaaaaaacaaagcaattgtcaaaaaaagttagaactattacaacccctgtttcctggtacttatctaatacttagtatcatgggggttgggaagtgaaaagtaggagaaaagtgagattttactaagacctgttttactttacctcactaacaatggggggagaaaggagtacaaataggatctttgaccagcactgtttatggctgctatggtttcagagaatgtttatacattatttctaccgagaattaaaacttcagattgttcaacatgagagaaaggctcagcaacgtgaaataacgcaaatggcttcctctttcctttttttggaccatctcagtctttatttgtgtaattcattttgaggaaaaaacaactccatgtatttattcaagtgcattaaagtctacaatggaaaaaaagcagtgaagcattagatgctggtaaaagctagaggagacacaatgagcttagtacctccaatttcctttctttcctaccatgtaaccctgctttgggaatatggatgtaaagaagtaacttgtgtctcatgaaaatcagtacaatcacacaaggaggatgaaacgccggaacaaaaatgaggtgtgtagaacagggtcccacaggtttggggacattgagatcacttgtcttgtggtggggaggctgctgaggggtagcaggtccatctccagcagctggtccaacagtcgtatcctggtgaatgtctgttcagctcttctgtgagaatatgattttttccatatgtatatagtaaaatatgttactataaattacatgtactttataagtattggtttgggtgttccttccaagaaggactatagttagtaataaatgcctataataac

SEQ ID NO: 230 - DNA, 5661 bp, Homo sapiens
  modified_base (7)..(7): a, c, g, or t
  modified_base (2992)..(3001): a, c, g, or t
  modified_base (3003)..(3007): a, c, g, or t
  modified_base (3591)..(3591): a, c, g, or t
  modified_base (3634)..(3634): a, c, g, or t
  modified_base (3636)..(3643): a, c, g, or t
  modified_base (4305)..(4305): a, c, g, or t
  modified_base (4307)..(4307): a, c, g, or t
  modified_base (4332)..(4333): a, c, g, or t
  modified_base (4343)..(4343): a, c, g, or t
  modified_base (4346)..(4348): a, c, g, or t
  modified_base (4350)..(4350): a, c, g, or t
  modified_base (4352)..(4353): a, c, g, or t
  modified_base (4355)..(4355): a, c, g, or t
  modified_base (4360)..(4363): a, c, g, or t
  modified_base (4365)..(4365): a, c, g, or t
  modified_base (4605)..(4606): a, c, g, or t
  modified_base (4847)..(4847): a, c, g, or t
  modified_base (4873)..(4874): a, c, g, or t
  modified_base (4941)..(4941): a, c, g, or t
  modified_base (5059)..(5059): a, c, g, or t
  modified_base (5138)..(5138): a, c, g, or t
  modified_base (5231)..(5231): a, c, g, or t
  modified_base (5595)..(5595): a, c, g, or t
  modified_base (5608)..(5610): a, c, g, or t
  modified_base (5612)..(5613): a, c, g, or t
  modified_base (5615)..(5620): a, c, g, or t
ccaccgncccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaannnnnnnnnnannnnngctatatttcccatcatcccagattgctaaatgttctttccaagaagtctgaatgaattattatatacatttgctatcatacatgacagttgtgtcattattagagatttcagtaattaaaatgggaaacagaagcctaagttatttaccttatcaaaaccacgttccttggaaccacattattatgatggtttttgtgctcttgtacgttggatgtcttaagctgagtacagtttaggggatcctttctaatgacaggaaggcactgctttcctcaacactgtgatctgacctgtgacaagtctgtactatccactatgtaaatggctcacaagtcaattgcaaacaaactgaatgtacaaatcttagtgctggtgctgaaatctcttcagaatagtcatcatgatttaaaagtttgtttaaaaatttgcaagcatcaagtgtcaatcaaaactgaagatgaaacactaatgaatgttgaattctcatgcttttaggtgtacttcctttttagaattttcagttttctgctatttttaccgtaactatttcgtttaaatttgtttcatttaagtttcctacangctaacttcgtttgtgcgattgaaataaaattgcagtatatanannnnnnnngtttgtgacacttagataatcttctgaaataatttgttttaaagtaagttatattggatgtgaaaaacaccttttaaagtccaagactttactacttaaaagtttacatgtcacgtcactattctttacagatttcatagaagtcgtgaatactaagtaatgtatacaaaagaaatatgtgatgatgtgtctactttttgtttgaaataactgttgggtgttccctcttcttattttctctctgcccaccttgacacagtaacttcctcttatagtcaagatgatgattaagtgtttaatttttattccattttgttctgcaacacgttcagatacttaaaactcattcatgcagttagaattatcctttatgtagtttgcatggtaaaggacattgtgtggtaaagggcattattgagtaatgaattttaagtatagcaaaatatgtatagtgtttatacatgatgctgatttcttaaaacctacatataagcagtagtactttttctctattataaagtattaattttgagttccattttataattctgatgtcttcattagaaatacaaaaatacaatccttgtattttttctttgaccagacccaaattttccccttcccccctccattctcctctccacttctcgtggaccgcgtgntnccaatattcattaacatttgcagcnnttacagagtnacnnntntnnanttttnnnntnttttttttttttgctctagcctgtctcatgttcttgcttctcttcatatgtaagtcagtatttttgtctacaaattaaaagtcacttgtcattcaaaaatgagttaagtaacatgataatcttttaaatttacctagctacaacttttatgtctcttgtaaatttatatatactttcagtgccattgtgaagaattggccttttaattctaagtagtattaccctatgaagcacagtgtnnaaaggtatgctacaaggtctctttaattcctgtgtggccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccactttngtttttaatagaaagatgagttcatnnctgtacatctctccaaagctctaaggaatgagaaaaggatcctagtatattgaaattactgatgttnaatacctctgccttttcactaaaagccatttaatatttttaaagtcaaaacttgacatacaggtatttataaggaatctccatgactctgaaggaatgaaattgatgtaggtagcttnggctatgtaaagacatagtagaggacaattacttaaagaagagttttcttttgaggatttgtagatttgactaagcagnctgaagtcagtaacccctcaagaaaggccgtttatagaagccaagaactgttggaggtctgtgatgcaggtttttctgttcccaacatcaaangctgtggattatttggtgtgttcccctttatgttatctctcgataatttttgagacatcaagattttttaaaatatcaatactggaaagatgaaaccttcaaattaaaacctaaaattgattagaaagaaaagtaaaatattaatgcagtaaatttaggatggttacagatactcaccatcaacataaataaatggagttctaggataaattatttgtggaatactaatggtcaagtcacataagagtaaaatcttttggtgaggagacacatttgacaactgctaaagaattaactaaatttgtctttctaaatagttttctttataaagtaacagaaacattgtaaaaggataaataaatgnctgtcataatgannnannannnnnnaaaaaaaaaaaaaaaaaaaaaaaaaaaaaaaaaaaaaaaaa

SEQ ID NO: 231 - DNA, 3524 bp, Homo sapiens
  modified_base (4)..(4): a, c, g, or t
  modified_base (19)..(19): a, c, g, or t
  modified_base (680)..(680): a, c, g, or t
  modified_base (708)..(708): a, c, g, or t
  modified_base (832)..(832): a, c, g, or t
  modified_base (843)..(843): a, c, g, or t
  modified_base (852)..(852): a, c, g, or t
  modified_base (874)..(874): a, c, g, or t
  modified_base (902)..(902): a, c, g, or t
  modified_base (911)..(911): a, c, g, or t
  modified_base (931)..(931): a, c, g, or t
  modified_base (996)..(996): a, c, g, or t
  modified_base (999)..(999): a, c, g, or t
  modified_base (1002)..(1002): a, c, g, or t
  modified_base (1007)..(1007): a, c, g, or t
  modified_base (1014)..(1015): a, c, g, or t
  modified_base (1018)..(1018): a, c, g, or t
  modified_base (1032)..(1032): a, c, g, or t
  modified_base (1037)..(1037): a, c, g, or t
  modified_base (1045)..(1045): a, c, g, or t
  modified_base (1049)..(1049): a, c, g, or t
  modified_base (1055)..(1055): a, c, g, or t
  modified_base (1065)..(1065): a, c, g, or t
  modified_base (1083)..(1083): a, c, g, or t
  modified_base (1101)..(1101): a, c, g, or t
  modified_base (1119)..(1119): a, c, g, or t
  modified_base (1123)..(1123): a, c, g, or t
  modified_base (1164)..(1164): a, c, g, or t
  modified_base (1802)..(1802): a, c, g, or t
  modified_base (1945)..(1945): a, c, g, or t
  modified_base (2319)..(2319): a, c, g, or t
  modified_base (2322)..(2322): a, c, g, or t
  modified_base (2569)..(2569): a, c, g, or t
  modified_base (2608)..(2608): a, c, g, or t
  modified_base (3157)..(3157): a, c, g, or t
  modified_base (3489)..(3491): a, c, g, or t
agcnccgcagcggggaatntgcagtaggtctgccggcgatggagtggtgggctagctcgccgcttcggctctggctgctgttgttcctcctgccctcagcgcagggccgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcagtaagacatcagagtaccatgatatcatgtatcctgcttggacattttgggaagggggacctgctgtttggccaatttatcctacaggtcttggacggtgggacctcttcagagaagatctggtaaggtcagcagcacagtggccatggaaaaagaaaaactctacagcatatttccgaggatcaaggacnagtccagaacgagatcctctcattcttntgtctcggaaaaacccaaaacttgttgatgcagaatacaccaaaaaccaggcctggaaatctatgaaagataccttaggaaagccagctgctaaggatgtccatcttgtggatcactgcaaatncaagtatctgnttaattttncgaggcgtagctgcaagtttcnggtttaaacacctcttcctgtgtggctnacttgtttnccatgttggtgatgaagtgnctagaattcttctatccacagctgaagccatgggttcactatatcccagtcaaaacagatctctncantgnccaanagctgtnncantttgtaaaagcaantgatnatgtagcncaanagattnctgaaagggnaagccagtttattagganccatttgcagatggatgncatcaccttgttactggnagancctcttgagtgaatactctaaattcctgtcttataatgtancgagaaggaaaggttatgatcaaattattcccaaaatgttgaaaactgaactatagtagtcatcataggaccatagtcctctttgtggcaacagatctcagatatcctacggtgagaagcttaccataagcttggcacctataccttgaatatctgctatcaagccaaatacctggttttccttatcatgctgcacccagagcaactcttgagaaagatttaaaatgtgtctaatacactgatatgaagcagttcaactttttggatgaataaggaccagaaatcgtgagatgtggattttgaacccaactctacctttcattttcttaagaccaatcacagcttgtgcctcagatcatccacctgtgtgagtccatcactgtgaaattgactgtgtccatgtgatgatgccctttgtcccattatttggagcagaaaattcgtcatttggaagtagtacaactcattgctggaattgtgaaattattcaaggcgtgatctctgtcactttattttaatgtaggaaaccctatggggtttatgaaaaatacttggggatcattctctgaatggtctaaggaagcggtagccatgccatgcaatgatgtaggagttctcttttgtaaaaccataaactntgttactcaggaggtttctataatgccacatagaaagaggccaattgcatgagtaattattgcaattggatttcaggttccctttttgtgccttcatgccctacttcttaatgcctctctaaagccaaaaaaaaaaaaaaaangacaaagcctcttaataaatttaatggaactatacatagaacagcagctcttcctcaccctttgcatacctttaatatttttccttcttaaattggccacagcaggggtcattcacactctcactgtcttgcaggaatcacaagaagtcttcatatgtgaacgtgccattcagttggtagttaagagcattcaacttcaaatatatagaagatatttgttttagtgcaaatccatgatggagtgcctcccttttccttttttcactttttgaaaaagatgttttgggtagtagtttaatatctcagggtgctctttctaacatagtaaaaaatgaagaaaaatgtttagattaaaactctgtagtctgatgacnttngaaccatccttgacccttaggcccaacctttccacagagaaatcacctctcttcctttgtcttttaagaactatttggtattaactagtttcagaattagtaaatgtgagattcagtcacataattatcagacattccatttgtcagaaatgtatttggctttttaaactcctttccacaaaagtttaagtctaatgaccttcttagagaagttgagcatgcctggcaagatcatttcatggaatangcagatgtttaaagttggatttttttttttttttttttngagtactagcaatgcacagggaccgtgttcttaggttcttagtctgtgaatctagcaataggcagtccagatttctgagtcgtactatggttttgccttgtcactgtgaggccctactaggtgtaagcattctctctgaattttaatttcctctcattaaaataggaacaaaatttgctatcctttagattaggagctgaagattcatttccctgggaatgtttcccatttagcttcaagtttcagctcaaacatcaccttctttctgactcctttcattcattcctccaggcagtaaggggctaccatagtactttgtttatgcctgtattatatgacatcactgtagttgcttgactgtttctcctactgttctgtaaacttattaatgggtgagaatctaattttactcatcttgatggcttcatgatccagcacagtgcctcacacaaagaactattgggtgggtggatggatggatggaggaatggagacagttggcttaaccagatcctatatacagattattactggctccaaaggatgagnagataagaccataagaattggatcaatgtaaatcctcacctgccctttgaagagccaataagggcatctttgtctttaaatacagcaaatgttattcagattttgtacttgtctatctgtttacctcagtgtagatgatatgaggatggtataactatgtaaattgtttttgaaaataatttgtttccccacaacttttgaaggttttatttgttgttgttattactagttcagtcccaaacttaccctttccttttcagagagctaatggccatgcttttcttcaaggaaagaataatttatttgaatgaagtgggatacttgcataacannnaaaaaaaaaaaaaaaaaaaaaaaaaaaaaaaaa

SEQ ID NO: 232 - DNA, 336 bp, Homo sapiens
gccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacagcaaaaaaaaaaaaaaaaaaaaaaaaaaa

SEQ ID NO: 233 - DNA, 2254 bp, Homo sapiens; identical to SEQ ID NO: 55
  modified_base (268)..(269): a, c, g, or t
  modified_base (382)..(382): a, c, g, or t
  modified_base (873)..(873): a, c, g, or t
  modified_base (890)..(891): a, c, g, or t
  modified_base (1376)..(1376): a, c, g, or t
  modified_base (1383)..(1383): a, c, g, or t
  modified_base (1385)..(1386): a, c, g, or t
  modified_base (1388)..(1389): a, c, g, or t
  modified_base (1504)..(1504): a, c, g, or t
  modified_base (1766)..(1766): a, c, g, or t
  modified_base (1789)..(1789): a, c, g, or t
  modified_base (1794)..(1794): a, c, g, or t
  modified_base (1796)..(1796): a, c, g, or t
  modified_base (1798)..(1798): a, c, g, or t
  modified_base (1995)..(1995): a, c, g, or t

SEQ ID NO: 234 - DNA, 2254 bp, Homo sapiens; identical to SEQ ID NO: 55
  modified_base (268)..(269): a, c, g, or t
  modified_base (382)..(382): a, c, g, or t
  modified_base (873)..(873): a, c, g, or t
  modified_base (890)..(891): a, c, g, or t
  modified_base (1376)..(1376): a, c, g, or t
  modified_base (1383)..(1383): a, c, g, or t
  modified_base (1385)..(1386): a, c, g, or t
  modified_base (1388)..(1389): a, c, g, or t
  modified_base (1504)..(1504): a, c, g, or t
  modified_base (1766)..(1766): a, c, g, or t
  modified_base (1789)..(1789): a, c, g, or t
  modified_base (1794)..(1794): a, c, g, or t
  modified_base (1796)..(1796): a, c, g, or t
  modified_base (1798)..(1798): a, c, g, or t
  modified_base (1995)..(1995): a, c, g, or t

SEQ ID NO: 235 - DNA, 2073 bp, Homo sapiens
atcctaatttctaaagcaatcaggagagaaagcttttagaatggcacatcatatctcattgatgccaacatggttttttccatggttctgactttctgtgaaggcaccagcttgcaatatgccatcccgtttcaccttgcatgtgagacagcaaacaaaatccacaaatggtgtgaactaatatgctggctgctaccttgcataaattaatgatttgatcacacgggttcttcgtggggttacatctgtgaatagcctgttttccacatgtaaatttgtgccttacaccttgagttgtgtacacttgtaaactctttatgatcaactgttcccccttttgaaataagtgcagatatttatttaaccctcccttccccaccctctgccccacttccagccctctgaaagattggagtcaagcagatggaagaatgcagtggtgatagttgtcatgcgacagctggagaacgctgggcagcaccacaccctccaattcacactgccttctagttgtgccaactggaaccaccctttggctgtgctgcgaaatggaccccagtgttgttgtgggtgtgtcaaatcccctttcatcctcaagagctccctgcttcccttagattatttcaatacggtgatatccttatttgctagcagaaaagggactaacgtccccattcctcttttctgctgcgtcccactggctcagagaagcaaggcggtgcgcggttgggcagaaacctgggaggagtctccaagcccaattcacagcacacaacggcagtgcacacaaagaaatgacatggaaatagatgcaggcaggctggtccctgctgtgattaacgagaactccaagtacaaggccgaccacaatggatgctgcaaaaacgttgactggggcaaaggattttttattttattttttattttgttaattatgtttttaggggatgggaggtggtgtgtgtttttctcctcttggttttcatttgctcaagcacacaaaagggacttttgtttactctatcatgaacaaaggaactgtccacatactgtaaaccatgagcagtgttgttgttgtttttttaaacagtatatttggtggtctctttgtctgcttttatttccagttcgatcttctgggtttagttttgtctttaaaaagaattcaaaaaaagactgacaatgacagttttgagttggatagtgaaaaagtggagcctccataatcagtgtggttgccttcagacctgagtacttagctgagggtgggtgagagccctttgttccaaaagtccattagttttgctgttgtttaggagtaggtggttgttgttgtttttactttttttttttttggcttttgtaatggaatccatgttcacatcctgtgaactctgtctcctgaaaccctgaagtatttcctagaacctgaaatattgttttcttccttgaattttctctagaaatgcagaaattaggaaggtgatgggtctgtatccccctgcccccttctttcccatgcttgactcccgagagtactggcagtgcagcacccatcattgacgtaagcggctgtcttgtccagtgtttgtagagcatcactgcctcagctgttaaggagacctgtgtcaaaacttacatccacattcctacacccccacaacccatcacttctggtgttaaccctaaaatacccacatgtattgagctggtcttctgcatttaagtatttctccccagtttttttccccactgtgtgtggggggagggtccataaacccgagtgtgcctttgctttccacccttgctagacactggtagatgcaacaaactcagatttatatttgttgtaaagttgtaaaaatattgtgatgtcaccaattttccttccatctccacatcccctaacatctgattcacgacttaatgtatgttgtaagaaaagaaaaaagaaaagaaaaaaagggaaaaaagaaaagcaaggaaaaggctctttattacttaaaagtaataaaacctgactgttctatattaaaaaaaaaaaaaaaaaaaaaaaaaaaaaaaaaaaaaaaa

SEQ ID NO: 236 - DNA, 1114 bp, Homo sapiens
ctgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaattgccctcctctctccaatccacagggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggctcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggac

SEQ ID NO: 237 - DNA, 703 bp, Homo sapiens
tcacttcacttttattatgaacaaacacaatctcagattagtacaattagcttcagagttgatattaatagaaattattccaaaattattcttgtcacaagtaactactatatcccacataaaaagggaaaaaatcccacccaatcacagaaaaggcatcctctgtatgtttccgtggcaatgcgttgtttatgtattctcaaattttgtctggctagttatccaccgcttctccaatggattcattcagtttcttggagaaccatatagactaatgacagcatctgggacacacggacgtatcaagttcatggtggacattcctattataaaaaatactcaggtcttgagaattcctgtgctgaaggatcccaaaatgctttctaaaaagcattagtcatgcctcaaaactgccctttgaggtaggtcagtattattatccccattttaacagaaggaaaactgaggcaccttatagttaagtgacttgcccagggtcacacagcaagtcagtggcacagtggttggagaggccctggccttaaccaccagcataacatggccacctcgcttttttaacctttcatgatgacctatttgagctacacttacagagaatacacccaagatactagcaaaccaaggagaaaattttccattttaaatgctacaaccatcttttaacccaaaaaaaaaaaaaaaa

SEQ ID NO: 238 - DNA, 1030 bp, Homo sapiens
ttttcttgagttacctcccgcagccgcagccgccgtgctcagcgcgagccccggagcccttgagcgcgaggcgcggagcccccggagcccccaaaccgcagacacatccccgcgccccagagccccggcctgcgcgcccagccgggcccgcgcgatgccctcagaccggcctttcaagcagcggcggagcttcgccgaccgctgtaaggaggtacagcagatccgcgaccagcaccccagcaaaatcccggtgatcatcgagcgctacaagggtgagaagcagctgcccgtcctggacaagaccaagtttttggtcccggaccatgtcaacatgagcgagttggtcaagatcatccggcgccgcctgcagctgaaccccacgcaggccttcttcctgctggtgaaccagcacagcatggtgagtgtgtccacgcccatcgcggacatctacgagcaggagaaagacgaggacggcttcctctatatggtctacgcctcccaggaaaccttcggcttctgagccagcagtaggggggctcggcctgggagtcggggggccccggtcaggccctgcccagagagctcctggttcctgaactgagctgcctctaccgtggtgggctgggcaggcatgtgcccccctagtcagagggcaccaacccacctactctgcccctgggtggatcctgggccggtcgtgttagggttgtccctctgggtgctggctggtgggatgggggagggtggggagcagctcccagcacccctgctgtgtggttcatcttttttttaggcccctgcctgtctgcccatctgcccctcacccacccgaggctctgcccaccgcctggacctgcccacccctgaaagactggcccctggctccccgcccctcggtctccacgtggtgtatggatctgtggtcattgtccctctgcagaataaagattgctcaggcctgcctggcaaaaaaaaaaaaaaaaaaaaaaaaaaaaaaaaaaaaaaaaaaaaaaaaaaaaaaaaaaaaaaa

SEQ ID NO: 239 - DNA, 3105 bp, Homo sapiens
  modified_base (6)..(14): a, c, g, or t
  modified_base (47)..(47): a, c, g, or t
  modified_base (50)..(50): a, c, g, or t
  modified_base (681)..(682): a, c, g, or t
  modified_base (1730)..(1730): a, c, g, or t
  modified_base (1893)..(1893): a, c, g, or t
  modified_base (2047)..(2050): a, c, g, or t
  modified_base (2052)..(2057): a, c, g, or t
  modified_base (2059)..(2061): a, c, g, or t
  modified_base (2066)..(2068): a, c, g, or t
  modified_base (2070)..(2070): a, c, g, or t
  modified_base (2075)..(2077): a, c, g, or t
  modified_base (2080)..(2082): a, c, g, or t
  modified_base (2086)..(2089): a, c, g, or t
  modified_base (2092)..(2093): a, c, g, or t
  modified_base (2095)..(2097): a, c, g, or t
  modified_base (2099)..(2100): a, c, g, or t
  modified_base (2688)..(2688): a, c, g, or t
  modified_base (2706)..(2706): a, c, g, or t
  modified_base (2714)..(2714): a, c, g, or t
  modified_base (2726)..(2726): a, c, g, or t
  modified_base (2770)..(2770): a, c, g, or t
  modified_base (2797)..(2797): a, c, g, or t
tttttnnnnnnnnnttttttttttttttttttttttttttttttttnttnttttttcttcattaaccctttattacaagtcacgctcttatagaagtatatgtggacttacgtgaaaaaatcaaatgtatccaagaataaaaaacacagcacataaagtagtatatgcattccagtgttcgcgccagagacggcgggcgcccaagtaaaagctcttctaaaacggcctgactggggcaggccgggtgcgaacggttccgggcctcaggcacagtgtgggggccgcctgcctcctccgcggcccggcgggcgggggcagcaccagctcctagggcctccgggccagcggcggaccccaggccggcccaagcccgacgccaggcagaaccctttgggcggggccgtatctggccctccggggacggcagtgacgacacccccagaaatgtgggcttcagggctggccacagggtaccctcagaagcccgcagcttagtcggcctttttcaggaagatctcgctcagaatcacccacacaggggagtccgtctggatcgagaggcgcagtgcttccagagggccgaaggctgggtccacctctccctctgccactcccttgtagaaggagccgatctggaggtagccgtcggggctccgagggtaccggagggtggcggtgcgnngccctcctgcagggcctccttgtctgactgagggttgtcgaagggcagcacctccacagacgtgttgaagagcttgtcctccgggtgctcgatgttcccactgcggaagaagaaccgctccagtcttagaggttggaagaagcggaagcggatgaagtcccccgcggcaggggtgaaggcccagaagaagtcctcgcgcaggtaggctttctccagggtgaagtgctggtatgtcttcaggctcgtgctcacctctgctggcgggttcacatgctccttccgcagcgcctgctttccaaagtctttgtccttcagtttctggatcttgccagccagcgaggagtgagtgcccacgtgctggaagagggacggtttgaagcggatccgcaggttggctttctgccggtcacagtgcttcgcatccttctcggggttgcagactttcacccacagaatatggtccaggagccagtcgatgggcttgtcccggtagaacatgagaatgaactctacaatcaggctcaggtccagcgacttgaacatcttaccaatgaagcccagctgggagaactccaggatcatccagtcctctgaaggctgctgcagtgcaaagttcttcatggtgctcaggtagttgggcttggccacgatgtcatcctccagctgcacgtagtagatgcctttggactgcgcgtacatcatgaggaagcagtaatcgaggttctgtttggtcctccacctgactctctccttggggtccccaaaggactctcggaggcgggagaagtcagggtagaagtggggggagggtgagatgacctccaggagcccagaatggatctccgtggggaacaaggccttgatgttctctgtcactgccgaagtgtactgtgagtcagtctcggcgatcagcaccacgatgaccgagtcctccttctcctgcgggctcagctcggagatgagcgagtgcagagtgtcagtcaggtacgagtgcacctcgcgccgcacgctcgggatgcccatcaccaccgacactccggtgcggccntggcccacgcgcaccgcgggctgcagactgctctccttggccagcaggtgtggcaggtgatggaagacggtgggcaggtgcagcacgtgccggtgtgagccgttccacggcttcaatcgggggtcctctgttaggcggccccaggtgcgattgccgtctccgntctcgcagcgcctgcctttctgacacggccctcttgatctcgtccagcaccaggttgagctccttggagcgcttgaggctctcctgctcagctgcgtgcaaccgatcgcgcagcgccaggaactcccgctggtaaacgtccacaacgtcgcctnnnngnnnnnngnnngccgnnncnagggnnnggnnnagannnnccnnannngnncctccagtgtgccagcgcacacatctgggtgtccacctctgcaatagctcattgacatctgttcttgtgcctgccacacgtgacatagctggggtcactctaaaattacactgacactaatgctcatggggagaaaaccaggggaattagccctcttccagtactctcccccaccgggggttattttatcctctgagaaggcatctgaagtggaaatacgatttccagacctaggtaggtggatcctaagcaagggctggaacagcctcagactgaatccgctccatccgttggcctccaaagcccactcttgctttttgcagcacacgctccctccagcgggtgggctacccaaggtcctggtgctagctcttcactgtccttgtagcggtcgctggttgctcaccctgcactggattcttagcctcacgatggccccggggggtggctgctgcagttccaggagcccacctcacttcattgctcaggtgagcaaatgaggttgagaaaccggccctggggctgctcaaggacagtcaacagcagcgaggggactagctctgaacgccctggtgcctgtgtctctgnagacctgtgctgcgcctngggcaccntgaagggtccgncatgccaccccagggggcccctgtcagaacctccagctgggccnaggcatgagggctgtaggtggatgggncagcacagaggtggggctgcccgacagtagagaggcaccaccagtctggcagggaccagtgagcaagaatgagatcaacaacctcctggtggctcggtgcccacagtccacgcagcaggacgctccaggcctctgccaggcgagtctctgaaaacctatgtggcctacaaggccttctgtttccaagtctccaagtttaagaagcctgaccgaactccctctacactcaggcagctcttccattccttgatccttggtggcttcacagaccccagagttgcgtgggatggcctcaccccaccagcagc

SEQ ID NO: 240 - DNA, 2596 bp, Homo sapiens
  modified_base (198)..(198): a, c, g, or t
  modified_base (411)..(412): a, c, g, or t
  modified_base (620)..(620): a, c, g, or t
  modified_base (1003)..(1003): a, c, g, or t
  modified_base (1211)..(1211): a, c, g, or t
  modified_base (1488)..(1490): a, c, g, or t
  modified_base (1496)..(1496): a, c, g, or t
  modified_base (2077)..(2077): a, c, g, or t
tttttttttttttttttttttttttttttttttgctgataagaattcttttatgttattccaataaaaaatacattcatacagaaatataacaatcttgcaaaaaacaatttcaaataaaatcttgtaaaacaaaattttacaaaaatcttacaaagattctttagataacagggtgcttccaaaaaaaaaaaaaaangaaatttcactaatagaaatttttttttaatttcaagcaaaaagtttctgcttgattgaggctcagttatcacctgaacagaatgtacttctttatgtacgtgctaattatgaaaatcacaggcattgacaggtacggtacccagccccacccaggcaaacagctccgacatgtttcgtaagtgagacaagccagtgcaagtttttttttttnntttttttttttttgtcttttgcttaccttcttgcttaatggaattgttatggctaagcacatagaaggccaaaaaaggagttttccaaacccagcaaatcaagtgcttggattctgaactgccaaaagaaaactgcacttcccctcttaagtaaaacgaaatgagtttcttaggtaaatgtattcatcagcccagataaaaaaaaaanccagttatgtgagcgttagtcactgctcatttccaggaagatcaaacaaaataccagcccagccagactcacatgtgtgtatatatatataaagcaaagagccacacccacaagccagcagctgggtgaaatatcagctgtccacgccgtggtatgccaattcggggaaattactccttggaaaaactggaagaatctacttgctggaaaaaatagcttcatctgcataaaaagtgttctacaaaagaatccctgtggttagcttactcttaggttagatcttctaataaggctgaaattcaaaatcaaaaccttagtgtgtccgagtccagcctgggttccagcattctgttcaggccacttctgaacggccgaaggtgccncattccagacctgcccatttgatggacagagcagacagcccggaacagattcaagcaagaaagtcctccgcacatcgttaaattaaagataaagcctctataaaagttaggttatggttttcatttttacctcctttatggccattttgaaatatttcttcacaggctgtggaattttctagctaaacattctagtttctccttaaanaaaatatttatatattatctatatatataatatatatatatacacacatacacatactgtacacacaaatatacatacacaagaattctgcccacttttttaaaaaagtagtatactttctgtattaccaacagatagctagacagatatgtgaaacttgtgccttttaagcaaatacattaacattgggggttttttaatacttctgtatctttaatatgtgtgaaaatgttacatattaaatacagccggtgtgtgatctatacaattgttgtgnnnggtctnatatgaaagtctcaaggtggcagaattggtcagatttttccattttcctgttttccattttaacactgacagtcaagttgcctaaagtgttgaacaaatactgacatgtaaagggagtttcactctatgtctttgtgaaggaggaccttaaagagattttttttctgtattatacgttgatacagtacactgccaggtgaaacaagagccttaataaagcatgcatcgcccacacccctgtatgagacccccacagaagggatcgcttgcgtaaggcaccattatgaaggtcaacagtgcattaacagctagaaaaccagaaattagtcctcaaggcataaataagagaaacatagctgcatgagaaaacagtttctaagcgttagtggttttatccacccaactgagaaaaattttaggttcttaagtctaatgaaacattagaccagcaattcccagccccagctttgtgacactcaatacgtgtccaatttcttctaagggcatcacagaattctccaaaaagttaattcaaattcagaatcatttaaaaataatcctgtgttgcacaatgcctttcnggaaggggagtgttacaaacttggaggggaaaaaaaattgtatattgccaggcccggatggctagggggtcactgtattagacagattggatcttagctgctcattaactggaatcagtattgcagtcctgacttaaaaatggaaaagcatatagttccccagaccatgcatgactttttgtattctaaggaaaagttaaattgttgtgttatatttgtaaatacacagcttatacaatgggttacaaatgagctatgttgtagcgtgtaaaacaagctacttgacacattgcacatttaatagctgcaccagacactaagagttcctctcacacagaaaagggggagagaggctctccctccccacaccactcgccactctggggtcctgagttcccacgcccaccctccaagattttccttctttttttgtttttgtttttttgtttttttgatttttctttttttttctaaggtgcagacaccccctccccccaaggaaatgattggtggtcatct

SEQ ID NO: 241 - DNA, 3118 bp, Homo sapiens
  modified_base (2)..(2): a, c, g, or t
  modified_base (123)..(123): a, c, g, or t
  modified_base (125)..(125): a, c, g, or t
  modified_base (2404)..(2404): a, c, g, or t
  modified_base (3084)..(3084): a, c, g, or t
  modified_base (3106)..(3109): a, c, g, or t
cngaggcagagtgctagcgggagcgcgagccagcaagaggcgcctgcgcgatgtccgggcccctgagcccgcggcgctgagccagccgggacggacatgcgcgggagggcgccgcggggcagncnccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaacaactttttaaatattgacccgataaccatggcctacagtctgaactcttctgctcaggagcgcctaataccacttgggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactcaaaaacaaaaatggatctgggtggccacgtgaagcgtaaacatttatcctatgtggtttctccttagaccttggggtcatggttcagcagaggttacataggagcaaatggttctcaattttccagtttgattgaagtgcagagaaaaatcccttagattgcaaaataaaatagttgaactctctgtcttcatgtggaaggtttagagcagttgtgagatgctgttatgctgagaaaccctgactttgttagtgttggaaaaaagtcttacaagtctataatttaaagatgtgatggtggggaggggaggatggggaagctttttatatatgcatacattacatacctatatataaacttgtggtataaccatagaccatagctgcaggttaaccaattagttactatcgtagagtaatatatattcagaataataaactcaagctggagaaatgagtcctgatagactgaaaattgagcaaatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgttgagggagggagagcaggttacttggcaaccatattgtcacctgtacctgtcacacatcttgaaaaataaaacgataatagaactagtgactaattttcccttacagttcctgcttggtcccacccactgaagtagctcatcgtagtgcgggccgtattagangcagtggggtacgttagactcagatggaaaagtattctaggtgccagtgttaggatgtcagttttacaaaataatgaagcaattagctatgtgattgagagttattgtttggggatgtgtgttgtggttttgctttttttttttagactgtattaataaacatacaacacaagctggccttgtgttgctggttcctattcagtatttcctggggattgtttgctttttaagtaaaacacttctgacccatagctcagtatgtctgaattccagaggtcacatcagcatctttctgctttgaaaactctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttatttatganaaaaaaaaaaaaaaaaaaaaannnnaaaaaaaaa

SEQ ID NO: 242 - DNA, 2644 bp, Homo sapiens
  modified_base (8)..(8): a, c, g, or t
  modified_base (38)..(38): a, c, g, or t
  modified_base (45)..(45): a, c, g, or t
  modified_base (50)..(50): a, c, g, or t
  modified_base (89)..(89): a, c, g, or t
  modified_base (109)..(109): a, c, g, or t
  modified_base (254)..(254): a, c, g, or t
  modified_base (734)..(739): a, c, g, or t
  modified_base (1938)..(1938): a, c, g, or t
  modified_base (1956)..(1956): a, c, g, or t
  modified_base (2061)..(2061): a, c, g, or t
  modified_base (2066)..(2066): a, c, g, or t
  modified_base (2071)..(2071): a, c, g, or t
  modified_base (2103)..(2103): a, c, g, or t
  modified_base (2109)..(2109): a, c, g, or t
  modified_base (2156)..(2156): a, c, g, or t
aacggagngagccaatgagtgcgagatgttgagtgacnagcgtgntccanatggaggccctccgtgctagtacggcttgcggcttaagngccgccgcggtctgcggaangtcaactattcaacatggaggcggaggtcgataagctggaactgatgttccagaaagctgagtctgatctggattacattcaatacaggctggaatatgaaatcaagactaatcatcctgattcagcaagtgagctgtcaccacngactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaacannnnnnttatacatgatatataatttcattttgtaaatgttgattgcacatgtggtcacattattgttgagactgcttttatgtgacctgtagtctcccacagaacctaaagtaataagctggcttttctgtgatagccacgtttgcgtatttctttccctatttcccttgcctgctaatgttgaacagcatgaacttgctttctgatgctgttttagactgtccctgttgtatctcaataatatctttgttttccttcagcctttattactataattgttcattctacatgaaagctaggaaactgaaattagaagagcacttatctgctacttgccagttttgcgtgagtgtgttatatgtatgtgtcaatttccctttaaaataactatttattttaaaataactattggcaataaggaaactgttcaaagtagaggcagatcttgatagaaagatgttaatcacagggttgtttataatagcaatatacatacacatttggctagtactaggtgaataggaaaataaatcatgctgtatgtatacaataagaggtcaagttgccaataaattattactgttaatgttctgggaaatgctgaaactatgctaagtgggggagagggaaagcaggtattgcagttttgtagtgaagattgggctttggagtcatatctgagatgtaagtagcagcttttaaattctagctatgaccctgtgcagatcacttaacttttgagtgtcaggatgtttggaaggacaagacaggaaagtgttttaatacagggttcagtatttagtaagccttcaataagtgatattacatacatgtaataaaaactaagcattgaaaggactaggaaaaatgcatcaaatgttagttctgcaggttatagaattatacttttatgtaattttaaaatttcagttatgaacatgtttgtccattaacaaacttataatagctgaaaaacagggttgtgagaacagcttcagttaaaattgtcctgtctagtttgaatatttcaagaacagaaagccttttttttttttttttttttttttgagacggagtctcactctgttgcccaggctggaatgcagtggtacgctctcagctcactgcaacctccacctcccaggttcaagcagttctctgccccaccctcccgagtagctgggattacaggcgcccgccaccncgcccggctatttttttntatttttagtagagatggggcttcaccatcttgaccaggctggtctttaactcctgatggtgatccacccacctcggcctcccaaagtgctgggattacaggcangagcnaccgngcctggcccccttttttttaattacagagaantaagtnacaccttagtatcagatattaattttcttcagtgttcaggcaattantatttagaaagctcttgtcatgagatggctctgggatgtgatgatgattgttgggattgaaaaaatggtagtatcatggagagatcataataaattcttagtattaaaagtggttttgctttcagttagggagaaaaattagattgtactatttttcctctatgatttccttcagttatcttccaaatgttgttttttccccacagcccccttaacattgttctctatgcacttctcaatacattttcatttgtttctcaagcctctttgtggatgactcctaaatataacttcttccactagctctagatccgtatttccaataaaatcccctacctgaatattcaagttaaacatgtccagaatacttactgattttattgttaatagccactattctgttgtctggaattaaaacctgtataactaatttgcatccctttatcttcttagtcaataaaacctacaatcctctttctaaaaaaaaa

SEQ ID NO: 243 - DNA, 738 bp, Homo sapiens
  modified_base (18)..(18): a, c, g, or t
  modified_base (20)..(20): a, c, g, or t
  modified_base (25)..(25): a, c, g, or t
  modified_base (624)..(624): a, c, g, or t
  modified_base (641)..(641): a, c, g, or t
  modified_base (671)..(675): a, c, g, or t
  modified_base (693)..(693): a, c, g, or t
ggcagcgccttttacggngncgtanagcagctcggccgagcagactgctgcggttcctgggtggcggcggcatggaggcgcgcttcacgcgcgggaagtcggcgctgctggagcgcgcgctggcgcggccgcgcaccgaggtgagcctgagcgccttcgcactgctgttctccgagctggtacagcactgccagagccgcgtcttctccgtggccgagctgcagtcgcgcctggccgcgctgggccgccaggtgggcgcgcgcgtgctggatgcgctggtggcgcgcgaaaagggtgcccggcgtgagaccaaggtgctaggcgcgttgctcttcgtcaagggcgccgtgtggaaggcgctcttcggcaaggaggcggacaagctggagcaggccaacgatgacgcgcgcaccttctacatcatcgagcgcgagccgctcatcaacacctacatctccgtgcccaaggagaacagcacgctcaactgcgccagcttcacggcgggcatcgtggaggcggtgctcacacacagcggcttccctgccaaggtcacggcgcactggcacaagggcaccacgctcatgatcaagttcgaggaggcagtcatcgctcgagaccgggccntggagggccgctgaccntgccggagataaaggatacagagagccccnnnnnaaaaaaaaaaaaaaaaanaaaaaaaaaaaaaaaacaaaaaacaaaaaaaaaaaaaaaaaaaag

SEQ ID NO: 244 - DNA, 1128 bp, Homo sapiens
  modified_base (26)..(26): a, c, g, or t
  modified_base (28)..(28): a, c, g, or t
  modified_base (269)..(269): a, c, g, or t
  modified_base (592)..(592): a, c, g, or t
  modified_base (902)..(902): a, c, g, or t
  modified_base (971)..(971): a, c, g, or t
  modified_base (1009)..(1009): a, c, g, or t
  modified_base (1040)..(1055): a, c, g, or t
  modified_base (1057)..(1059): a, c, g, or t
  modified_base (1061)..(1061): a, c, g, or t
  modified_base (1063)..(1063): a, c, g, or t
  modified_base (1065)..(1065): a, c, g, or t
  modified_base (1069)..(1069): a, c, g, or t
tttttttttttttttttttttttttntnttcaaaacagtttattttattttatttttttttttgtcagacaaacacattgatttctggaccacagtagaggatggaaacctttcacaaacttatttatttgaaaatacaaatataaaattatactttccacatctgtgatgtgagagactgccatccacatagtaattttttacaacagggctttaagaaagccacacacaaagacctgaaagatgcttgagatatatatatagatagntacatatatatgtatatatataaaaaaaatactcactaccaaagttctcatcagtttcatactaaagtataaaagtaagggtgaggtcagccacagtgctagggaaagttttatttagatacatttatgtccacatgaaacgcttagacttgcatcctattacatatggaattcggagtttacaatacaccatgaacggcagattggctagcccacgctacttaagaggacactcacagattccacatgggatggtacattatgtacagaatacagtagtagagaaccttcgagggaggctctggaacttttgtctctcagcntccggccccctcccccatcatgcccctgcctcccggaactgaaatcctgtctgagacaatacattctgattatttgatagccaggtgtttggattaaggttgcccccctgcaggtccccgacaagagggatggattttatttatatgtttttgtgttttagtttacttacttttttttggtagaaaaaaaagaaagaaaaagaaaacaaacatattacagtattaaagtattgcttaacttccagcgtctccttgtgtagtgtctgtgcccaggacggggctgagctgacgtctgctagttttctgcttnggggtgagggtggggaaacccgccagtgtctttcttcaatgtgcttgcctgcagtcagtccctctgctntcccactgtctgccttccttggaagatagcctggcttncgaagcacattcaagaaaaaaaaaaaaaaannnnnnnnnnnnnnnncnnncncncnctcnccctctgttcctgcgtgccacttgcaaccaataaagagaagtatgagttagtgtttctt

SEQ ID NO: 245 - DNA, 2758 bp, Homo sapiens
  modified_base (74)..(75): a, c, g, or t
  modified_base (79)..(80): a, c, g, or t
  modified_base (82)..(87): a, c, g, or t
  modified_base (90)..(92): a, c, g, or t
  modified_base (95)..(95): a, c, g, or t
  modified_base (99)..(99): a, c, g, or t
  modified_base (109)..(111): a, c, g, or t
  modified_base (803)..(803): a, c, g, or t
  modified_base (944)..(950): a, c, g, or t
  modified_base (952)..(952): a, c, g, or t
  modified_base (996)..(996): a, c, g, or t
  modified_base (1329)..(1329): a, c, g, or t
  modified_base (1392)..(1392): a, c, g, or t
  modified_base (1399)..(1399): a, c, g, or t
  modified_base (1411)..(1411): a, c, g, or t
  modified_base (1430)..(1430): a, c, g, or t
  modified_base (1627)..(1627): a, c, g, or t
  modified_base (1732)..(1732): a, c, g, or t
  modified_base (1876)..(1876): a, c, g, or t
  modified_base (2065)..(2065): a, c, g, or t
  modified_base (2255)..(2255): a, c, g, or t
  modified_base (2261)..(2262): a, c, g, or t
  modified_base (2264)..(2264): a, c, g, or t
  modified_base (2342)..(2342): a, c, g, or t
ccgagttttttttttttttttttgggaaaccataaagggtcgggcactttagttttggttcacatgaatagcanntttnntnnnnnnttnnnttntttntttttttttnnntttaactgatatattttttatttattaatgtaggctaaacaagcagaagccatcagtaagagacaagaggaaagaaacaaagcatttattccacctaaggaaaaaccaattgtgaaacctaaggaaggtaatgctttctatgatgtaaaagtctttattaattaggaaaagtaaacccataataaatttgtctgaatctttttaagaaacagttgtatcttttcatcagttctcttagcatttcattaattactaatcctaaggacaagggatggctgagataatttataatttagaggcagctaatgcctatttcagtgcaaactggattgacagtcctctcctgacctctggtctgtgcttggaaaagactctttgttgtgaaagatacaaacccagggcagccagtgcatcttctgtagaaatgcaagaagatccctgagctctgctgtcatgcctctcaaagaggaattatcagaagttgtactttttcttctctttatgtgatcttggcttagagtttggcttctatatcggtaacatggatttctcatcaccttagactaaaggatgctgacaggtcttattcaggagctattagtgcgaaagtgattgtggtttttaaatggcagaaatcactttcgcactaacctagtatttaaaagacactaagagaaaacattgtcatgccnatttcttctgatgcatcctcttctgcatttttttcccctgtggtaacacttatcctcttcctaaagtaaccctccaaagtgaacagtgacacactgaagggagagggctcaccagcaatattgtacatagactgggtcagnnnnnnntntaatacattattattttaatatattgcttgttaatagctttaanaatactacattctatggtagattattggttatataaaaggtagaaatgtcataagtattataatttccagtctgtaaaacctgtcagttgagtgctttgaaggtactcaatatactcaatagctagttaccctaatttagtttctccacacggtggaggctttaacactctgtgcttctcaggttgctgggtagtttgatgttttatcttatgattcttttatgctgtgatcctgtactttgaatggtaagaaaaagttgcattctttttcactgcttcctttctctattttgttcacacttttggcattgattagatagttggcttctattnagggggacttccacacactctcaaattattgtctttattaccaaaatgttgttaaatataccnaaaatcntgttaaaatacntattaattagtcattcatngaattaatattcaatgaattaatctaacattaaatgaattcattgaatattcaattaatattgaattaatatttggaaaactttaaattttcgttttgatattagaggaagtagattttgacctctagcttagggttagctgattaaacttattgagaagggatacatgtaattttaaattattttaatgtgcaagntggaaaataatgactcagaagttccaaaatatggaaaagaatgtaggtaaaataatttagtctgaagtaggatttaaggaaatagtcttaatatagttgaatccngtaattggttcaattatgccatttatgccatttttatgtatacttgtactaatatataaagtattttatgatttgttttatcttaatctgaagaaatttctaactgctttaggcaagtgtttttatattttatactgtgatcanctttcaattattcaattataagaatactctgaagttaactgccttaaacatatattctttgttaaacatatattctttgttttacttggtaaaatctaaagtattacatgtgttgtgcttttaatttgtctagcttctactgaaactaaaattgatgtggccagcatcaaggaaaaggttaagaaagcnaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggctttttntttttnngntggtggtggttgttcatagaagagtgttctttataaattatattattattgtattttttgaaaaatttatactagaangtggtatatatgtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacatgtcatgaacagaaaattaaggcctgtaaaatcagatccactagctactcctctgttctgaatctggtgaagtagtaaaccaaaaagacagggaaaaccatatatttagagtcgaagcagcatgcaaaaaataataatgtttttaactaatgaaggctactggagttacttaagaaatcacccttaaaaaatggttgcttttactttgtttaaacccccccctttgcttcatatttggccaagggaa

SEQ ID NO: 246 - DNA, 732 bp, Homo sapiens
  modified_base (8)..(15): a, c, g, or t
  modified_base (35)..(39): a, c, g, or t
  modified_base (41)..(43): a, c, g, or t
  modified_base (81)..(81): a, c, g, or t
  modified_base (706)..(710): a, c, g, or t
  modified_base (712)..(715): a, c, g, or t
  modified_base (717)..(717): a, c, g, or t
  modified_base (719)..(726): a, c, g, or t
ctctacannnnnnnncttcagctgcattctaggannnnnannnactactgagctgcaaatctatgctaagcatataagacnatgactgaaagggaaaaaaatttttttaattacaaactcaattcatttggtgcatttcaaaggtgcaatacttttcttcatttatcagtgaaagaagttagaaattaacttcccaaaaaaatcagcaaatggcaaacaaatgtccttgaaagtcacagtcacatatagtgcgtcctagaaaagaggaggggcaagatgggctccacccactttcatgagtttcatcaaatactggatctactcaagggtggagagaaaaggcaactttcaaaaaggagtatgttattaaatgaggcatttactatactccttcctaagagcaccagatggggaacatgttttctaaactagatctaggaagtggaatgtggaatcaatccgtcctcctccccttaagggctaaccactggttaatgaattaaaaaaacaagactaaaaaacaaaccccacacacactcccccccaaaaaaaagaggagggaaaaaaacaaaacaaaacactaagatgtcccagattactctccagagtggaaccagggagcagcttcaacaattccaattagtctgttacagagtcatccacaagcatgccttgcttttaaacaacaaaaaaaaaaaaaaaaaannnnnannnnanannnnnnnnctctct

SEQ ID NO: 247 - DNA, 1258 bp, Homo sapiens
  modified_base (140)..(140): a, c, g, or t
  modified_base (142)..(142): a, c, g, or t
  modified_base (146)..(146): a, c, g, or t
  modified_base (404)..(404): a, c, g, or t
  modified_base (775)..(775): a, c, g, or t
  modified_base (1088)..(1088): a, c, g, or t
  modified_base (1163)..(1163): a, c, g, or t
aaggcgattaagttgggtaacgccagggttttcccattcccgacggttttaaacgccgggcaattaattgtaaaacggctccctatagggcgaattgggaaccgggccccccctcgaagtttttattttttttttaaatntntttnttttttttttttttttttttcttttaaaatggcttttattgagacacttgtagggattctgcaacatttccagttgggaatctttatttccaactcttagggtggctaaacccttttctgaatgccaaaaggcacactctcaccaccttaatgaggaaacacacttatctgtgtctgttccgatatccaactgggacctggaccccaagccccgtggtgtcttgtacaagtctcattagtcctccacgtacaactcanaagcctgttaatcagggagggtaatttccaaataaatgtgagctggcctaaatccagctggttatttctgatttggtaatctgtagtatcttaatttggggacatcctgtcctaagttttggctggtgcatgtagaacttataatctacctgtataacaacagatgcaacatagctccgttccagccccaaattccttaaaggttctagtctactcttgcacttcttcctgtactgttgttgagaagcttacattttagggagaggctggtcaaatctctactctctggtaacagcattaacaagagtctttcttttggaaacagactcagaagttatggacatcagccacttcagacttctttaggccantatccttgaggtgactgaccagcctcctcatggattggagtttcccatcattgttttaattgctggaaatgttggcctaattctgcttccttgtaactttctgctttttagtacaagttctcttgggaatctacgcatggtaaaaataccagctccttccatctttacagccctgtcagtgctgtgctcttcaaagcctttcccttaatagcaagagggccaagagtggcaaatagaggcagagccgcctgcactacagttgttcccatcgtaaggtgaaaacgaacgtttaacttcatctagaagaaaaaancaaacaaaaaacccatcaggctattaagattctgcttgcaaattaatgccaatccatgtttacattttttttttnatcattgagacatttacatatatatgcaggctctgctccttaacaaaaggtgaactgaaaaactcaagggtgtttgtttttcagttaaaaaaaaa

SEQ ID NO: 248 - DNA, 1718 bp, Homo sapiens
  modified_base (35)..(37): a, c, g, or t
  modified_base (39)..(39): a, c, g, or t
  modified_base (41)..(41): a, c, g, or t
  modified_base (43)..(58): a, c, g, or t
  modified_base (61)..(61): a, c, g, or t
  modified_base (63)..(63): a, c, g, or t
  modified_base (65)..(66): a, c, g, or t
  modified_base (69)..(71): a, c, g, or t
  modified_base (74)..(76): a, c, g, or t
  modified_base (116)..(116): a, c, g, or t
  modified_base (183)..(183): a, c, g, or t
  modified_base (223)..(223): a, c, g, or t
  modified_base (233)..(233): a, c, g, or t
  modified_base (240)..(240): a, c, g, or t
  modified_base (273)..(273): a, c, g, or t
  modified_base (314)..(314): a, c, g, or t
  modified_base (1094)..(1094): a, c, g, or t
  modified_base (1691)..(1691): a, c, g, or t
  modified_base (1696)..(1696): a, c, g, or t
  modified_base (1699)..(1699): a, c, g, or t
  modified_base (1715)..(1716): a, c, g, or t
ggcaggaccagtggggcccaaatcttgctgctctnnnantntnnnnnnnnnnnnnnnnagncncnnctnnntcnnnctgccctggagaaaggtagggtgtgctgggcctgcccctngcaaatgggattcaccagtttcatttatttgactctactgccacagtgaaaagagcaaacagctatngggttgcaaacctcctttgacattaggaaatgttgacttngtaacaatanaaacttnggtcctagaaagacacggttgtcctgggagttngtagtgttaagttgcaacaacaacaacaaaaagcaacaaanccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagagaagcactgctgcttgtctggatataggctgaggatgattgagagaagctgtgggaactgacacaagggtctgcataggtcatcctgtgaccctggggactatgttaccaactgacagacagatctttcactgtatcctagcagggcaggtagtccaccaagaaatgtgcttattggattgggaggtgtttatttgtagtctgctgtaacacgtgtgaaagagcaggagcgtcatcagcatatgacttgcgctggtcatccggtaaatggatgtgctgtagtcccagtgctaatcatttctctccttcacagtgggtggaagtttagggttaaatgtcctttgaatgtcacctggtgagtccttgacaccttaggctcttcagaaacaatggttttgttgaggatggggaacagggaatgccgattttatatacatggtacacagagaggggtgtcacttcagaaaatcttccagcatgttcttcagaatattaatttatatgcgaggtgaggttgggaatgaaaagaacaggtcagcacttttttttttncctagaacatacaaaagaacatggtggactttcagggagtgcaatggaaggtgaatatttccttaagggtccccgagaaatgggagtgaggggaggggacacaatggctttttgagcttacttttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaaaattctgattaaattanctganaanaaaaaaaaaaaaaaannaa

SEQ ID NO: 249 - DNA, 1017 bp, Homo sapiens; identical to SEQ ID NO: 58
  modified_base (234)..(234): a, c, g, or t
  modified_base (238)..(238): a, c, g, or t
  modified_base (243)..(243): a, c, g, or t
  modified_base (301)..(301): a, c, g, or t
  modified_base (387)..(387): a, c, g, or t
  modified_base (406)..(408): a, c, g, or t
  modified_base (1001)..(1001): a, c, g, or t

SEQ ID NO: 250 - DNA, 1130 bp, Homo sapiens
  modified_base (72)..(72): a, c, g, or t
  modified_base (89)..(89): a, c, g, or t
  modified_base (139)..(139): a, c, g, or t
  modified_base (149)..(149): a, c, g, or t
  modified_base (158)..(158): a, c, g, or t
  modified_base (448)..(448): a, c, g, or t
  modified_base (486)..(486): a, c, g, or t
  modified_base (624)..(625): a, c, g, or t
gagtgtctttaaatgaggtgttctagacagtgtgctgataatgtatgtgcgggtgacctcttcgctatgatngtatctcttactgtttngttaaagaaatgcagatgtgtaactgagaagtgatttgtgtgtgtgtctnggttgtgatnggattcttnggggggggggaactgaaacatttgtcatatactgaacttatatacatcaaaagggattaatacagcgatgccaaaaagtttaatcacggacacacgtccgtttctgtagtccgtatgctctttcattcttggtagagctggtatgtggaatgccatacctctgaccctactacttacctttttactgacagactgcccacactgaaagcttcagtgaatgttcttagtcctgttttcttctgttactgtcaggaaactgagtgatctaatggttctctcacttttttttngttcttttagtgtactttgaagtatcaaatcttaactnggtttaaacaatacatattcctaacctttgtaaaaaagcaaagattcttcaaaatgacattgaaataaaaagtaagccatacgtattttcttagaagtatagatgtatgtgcgtgtatacacacacacacacacacanngagataaacacaatattccttatttcaaattagtatgattcctatttaaagtgatttatatttgagtaaaaagttcaattcttttttgctttttaaaaaatctgatgcttcataattttcattatattattccacatatttttccttgaagttcttagcataatgtatccattacttagtatatatctaggcaacaacacttagaagtttatcagtgtttaaactaaaaaaataaagattcctgtgtactggtttacatttgtgtgagtggcatactcaagtctgctgtgcctgtcgtcgtgactgtcagtattctcgctattttatagtcgtgccatgttgttactcacagcgctctgacatactttcatgtggtaggttctttctcaggaactcagtttaactattatttattgatatatcattacctttgaaaagcttctactggcacaatttattattaaaattttgaatccaaaaaaaaaaaaaaaaaaaaaaaaaaaaa

SEQ ID NO: 251 - DNA, 2110 bp, Homo sapiens
  modified_base (13)..(14): a, c, g, or t
  modified_base (19)..(26): a, c, g, or t
  modified_base (28)..(28): a, c, g, or t
  modified_base (493)..(493): a, c, g, or t
  modified_base (496)..(496): a, c, g, or t
  modified_base (526)..(526): a, c, g, or t
  modified_base (533)..(533): a, c, g, or t
  modified_base (544)..(544): a, c, g, or t
  modified_base (1142)..(1142): a, c, g, or t
  modified_base (1249)..(1249): a, c, g, or t
  modified_base (1257)..(1257): a, c, g, or t
  modified_base (1604)..(1604): a, c, g, or t
  modified_base (1733)..(1736): a, c, g, or t
  modified_base (1738)..(1739): a, c, g, or t
  modified_base (2069)..(2069): a, c, g, or t
  modified_base (2079)..(2079): a, c, g, or t
ttttttttttttnnttttnnnnnnnntnttgatgtcactgtggtttattaggtaaatacaaagtataggctcttgcattttttaaaaagcaaaaccaaagagattagaaaccaagtacacatatcctctttagaagagaaacataaatcagttttaacaattaggcacttaaaaatgtaaatgtaagacaacattatagaagtataaactatagttacactcctaaattcctcctgaaatgtttacaaacacaaaatcacaagcatggaaaacaaatttcctctttatcaaaaaaggaacctgaatttgaatccaatgtgataaaccaatgattaaggtactggtgggtaggaaaaaagagcttctgaaatttacatatttgattaaaatgtaagcatttcataaaactatcacaatagcatacagtagatatcataatgaaaaatatatgtcaggaaaataatgaatctagacttaaaattttactttacancanggcacttaacacattgaaacagtacagtanatttccnaaaagaatgcnattggctacctctgaaaccttgtaataatatttcttttgtgaatatacggtaacataaccatacattttgcagcattaatcattgcataggaggtaaattaaataatgaattctaacttggcaattagattagtttttgttcatcgtttcctctttttcttttaaaggacagttttaaataatttcacaataaagcactcttctcattcatgatttatttagaacacagcataatgagtaagaaaataaatcagaacttataaggtgtgtatctgtataaaaacttatctttgggtaacattgacatgattttcagtgtttgggtgttgaagtcaagagcacttcttaatagaagaaatattttcagcaactgagtcaaaggagttaaattattgcaacacaaggacactaaaaacaaatactaaaaatctttatatatataaatagaaaagccttcaacacatggcatataacttataatatgcttgatttaaacgtgtaaactcattaagaaactccttctcacacttccttacactacagaggctagtgcattaagattggcttaaagttttcatcagttttacagtgcaaaacnaaaacaaaaaagaattaagaaagaaatgttcaaactattcaaggggcaagatgtgaactttcaactaaaaaagaaactgcatgagttctgtcatgtaaaaaaaaccnagacaacnaatttggtgtttcaaagtaaacaaaacataggtcgttataaagggagacactaatgattgtgatcatgagaggtaaaaatgttctacaaattttctttgatcaaatggatacaaggttagaattacaagtgcctataatctgagcacattttacctttgggaaaggtttaaaatgcttttaaaataattcctttcacatgatactttcagattattggcaaacaacagaaaacaaatgcctttcaaaaacttgaaaacaggcttttaaaagtggtgtttgcattccaagtcataaagtatattgccacaagggggcactggtaatacaggaaataaccctaatgcantgtcatccacaaaccagagtagactcaacgctcactctcaaaacagccttcctgccacagcaaaacttgtttcccaagatgccagtaaattaagtaacaaattcacaattagttcaagtggactcaggnnnngnngctttattttcagatctagtggacaagctcaaaaactagaatctgagagaatttcatttgaaatgagttagaaaaaaaatgtggcatactctataggaattatatgttataggtatttcacagacaacctaaattacaggaaaagcttcaaacaggagcatagacttgaaaaaaacaaagataataagatatgtatcttaactggcaaagaacaggtaccccaaacatttatgatttcaaaggcaagatcatacttgttttatatcttcagtttatatatatatcatacttgttttatatcaaagtggcacattgggttgaagctcaacntttctttccnacatgtaaatgggttttactatttgttttat

SEQ ID NO: 252 - DNA, 1009 bp, Homo sapiens
  modified_base (517)..(517): a, c, g, or t
  modified_base (552)..(552): a, c, g, or t
  modified_base (803)..(806): a, c, g, or t
  modified_base (809)..(809): a, c, g, or t
  modified_base (837)..(837): a, c, g, or t
  modified_base (882)..(882): a, c, g, or t
ttttcttgagttacctcccgcagccgcagccgccgtgctcagcgcgagccccggagcccttgagcgcgaggcgcggagcccccggagcccccaaaccgcagacacatccccgcgccccagagccccggcctgcgcgcccagccgggcccgcgcgatgccctcagaccggcctttcaagcagcggcggagcttcgccgaccgctgtaaggaggtacagcagatccgcgaccagcaccccagcaaaatcccggtgatcatcgagcgctacaagggtgagaagcagctgcccgtcctggacaagaccaagtttttggtcccggaccatgtcaacatgagcgagttggtcaagatcatccggcgccgcctgcagctgaaccccacgcaggccttcttcctgctggtgaaccagcacagcatggtgagtgtgtccacgcccatcgcggacatctacgagcaggagaaagacgaggacggcttcctctatatggtctacgcctcccaggaaaccttcggcttntgagccagcagtaggggggctcggcctgggagtcngggggccccggtcaggccctgcccagagagctcctggttcctgaactgagctgcctctaccgtggtgggctgggcaggcatgtgcccccctagtcagagggcaccaacccacctactctgcccctgggtggatcctgggccggtcgtgttagggttgtccctctgggtgctggctggtgggatgggggagggtggggagcagctcccagcacccctgctgtgtggttcatcttttttttaggcccctgccnnnntgnccatctgcccctcacccacccgaggctntgcccaccgcctggacctgcccacccctgaaagactggcccctgnctccccgcccctcggtctccacgtggtgtatggatctgtggtcattgtccctctgcagaataaagattgctcaggcctgcctggcaaaaaaaaaaaaaaaaaaaaaaaaaaaaaaaaaaaaaaaaaa

SEQ ID NO: 253 - DNA, 1807 bp, Homo sapiens
  modified_base (72)..(72): a, c, g, or t
  modified_base (79)..(79): a, c, g, or t
  modified_base (94)..(94): a, c, g, or t
  modified_base (182)..(182): a, c, g, or t
  modified_base (324)..(327): a, c, g, or t
  modified_base (329)..(334): a, c, g, or t
  modified_base (676)..(676): a, c, g, or t
  modified_base (812)..(813): a, c, g, or t
  modified_base (815)..(817): a, c, g, or t
  modified_base (819)..(819): a, c, g, or t
  modified_base (822)..(822): a, c, g, or t
  modified_base (824)..(824): a, c, g, or t
  modified_base (1313)..(1313): a, c, g, or t
  modified_base (1317)..(1317): a, c, g, or t
  modified_base (1350)..(1350): a, c, g, or t
  modified_base (1360)..(1360): a, c, g, or t
  modified_base (1368)..(1369): a, c, g, or t
  modified_base (1371)..(1378): a, c, g, or t
  modified_base (1384)..(1385): a, c, g, or t
aatataatttcccataaaacatgaagtcctgttttgagttttattcccatgtgctatggtccctttggtcangtaccanggctctatttctgcntaagccccaagtggccatgctagcagccagccactatcgatttcctgtgaccgatgccattcctgagatcttcgcccatttccgttgnagggttgggactgtaagagcttgatgccacctctgtcacacatctcgccctgaagcaaacagggattcacactgctttagtaatgttgactcccaagaacccaagaaagtcaattaataatccaccaagtccagcctaaacnnnncnnnnnnccatacctgtttacatggaattacatccatgttaaaaaaaactaagacacaagaatcttaacattaaaacagaaagtagctcttcaagagtctaagcattacaaaattacatacactatttaaatctatcaagaattcattaaaaggtttagtgaaatgtttaaaagtttgattacatcagctataggagtaaagtgctaacttacaaagcttacagtttgtgacaccagtgataatgcatgcatactgctattttcaccaccaactggtgaaacaatgaaaagacagtttacttttactgagataccgaaatgagtcaaagactatattagccaatataantcctttgtttttagtgtgaaatactatggtagggcctaattaaaaataaaaacaatatggagaacagtaaaacagtcatcaagtgactctaagcttgtatttactctaagcttgtattaagcttgtattgactctnntnnntnttntnttttttttttttaatttctattcagggatccaagaattttagtaattattaactgagcagcagattgccactggactgttttaagatttactatcaccagtcttacatagatacataaattttaaaatctcacccatttcttcttataagactattagaagatttaacttgccacagactggtcatgctttgttattcttggacccctgctttttcccaaaccactacattcacctttttgctataccaaactggaggtggtaattcttagttgagtcattttacctaggggaccacggtacagcgataagtcactcaattactaccttatgattgacagttcacactggaatcaaaggtgaattcatgggagtagaggtgagatatcgttaggcaagtctacaaagagagatagatgggcatttattcatcacgctgaagtgaaactactgcacaatattattacatcaatagcatatatttactttngtangttacacgtaatgcatctctgataagataaatnaagagggctnccgggganntnnnnnnnnatttcnncagtagtttcgtgaataatgctaaattaagaaatatataaacctcaccgacatgttttttctcaccttcttgtaaggagcctcaagcattgcttcaatatcaatatcgtctgccattttctctaaacgcctgttccggccttcgggcgcctgtggtgctcgtgttcgggaagagattgctgctgctgctgctgctgctgccgccgccgccgcttctgttgctactgttaagcccctaggcccaggccgcggaaccgcccagcccgaatatcgggttccaaggacggctaggcccgagagaatctaaaaaaaacaatggaattagagaagcccacgcgggagagcaggacggcggcttcggcagctcaggatccacccctgcgacagcgtcgacaagctccctgaaatggcggccgcaagctt

SEQ ID NO: 254 - DNA, 898 bp, Homo sapiens
  modified_base (356)..(356): a, c, g, or t
  modified_base (670)..(671): a, c, g, or t
atttattttatttgcaggaggagttgaaacaaattttaagggagattttcattttccccctaaacatgaatcattcaagtaaaaccaacttaactatagaaatgtagcaaagtaaggggaaagcagcacaacaacccaagaggcaaaggctgggggggagaggtgggtgcagtccgcatataacatatgcataaatgccttatgattcacctgctcaggaccgcctccccagaaggcaagcacaaggacccattttaagaggatgtttccccccaaacatctgagaatgcttcaacttaaacagcttaaggttaaaaagacaaagaaaaaaaaaaagaaacccaaaaaaacccctngaaccacccagccataaccaccttccttaatcgatcataggagtttcttttcattttataaaaagattaataaaaaatattgaaaaaattttctcatatttgtaaagataatagaattcataagtttcttagaaaacagaccagacactgccctccagtttccaccccgttgctgggaggatcagcaggactagaaagtttgggatactggagctgctggtggagaacggggaagtccagcccagaagaaatcaggaaatagggctcaggggcacgtgaggtgtggtaaggagcaactccacgtgatacatggnngcgcagaaaaggggaacacaaggtggtcggaaaggccttaaactcctccttgacatacaaaaccggtttttacaaagatccaagcagtttggtcccaaactgaggtgaacacttcaaagtttattcacatgcttttgttttctctttcaagaatcaaagtttcccaaattaaatgtttctaatattactacatatgcctaaaaaaagaaaaaaaaaaaaaaaaagag

SEQ ID NO: 255 - DNA, 1936 bp, Homo sapiens
  modified_base (27)..(27): a, c, g, or t
  modified_base (220)..(220): a, c, g, or t
  modified_base (237)..(237): a, c, g, or t
  modified_base (253)..(253): a, c, g, or t
  modified_base (292)..(292): a, c, g, or t
  modified_base (300)..(300): a, c, g, or t
  modified_base (312)..(312): a, c, g, or t
  modified_base (329)..(329): a, c, g, or t
  modified_base (340)..(340): a, c, g, or t
  modified_base (342)..(342): a, c, g, or t
  modified_base (367)..(367): a, c, g, or t
  modified_base (740)..(740): a, c, g, or t
  modified_base (1223)..(1223): a, c, g, or t
  modified_base (1230)..(1230): a, c, g, or t
  modified_base (1234)..(1234): a, c, g, or t
  modified_base (1239)..(1240): a, c, g, or t
  modified_base (1242)..(1257): a, c, g, or t
  modified_base (1259)..(1263): a, c, g, or t
  modified_base (1265)..(1267): a, c, g, or t
  modified_base (1269)..(1274): a, c, g, or t
  modified_base (1277)..(1278): a, c, g, or t
  modified_base (1280)..(1280): a, c, g, or t
  modified_base (1290)..(1290): a, c, g, or t
  modified_base (1301)..(1301): a, c, g, or t
  modified_base (1305)..(1305): a, c, g, or t
  modified_base (1309)..(1309): a, c, g, or t
  modified_base (1316)..(1316): a, c, g, or t
  modified_base (1319)..(1319): a, c, g, or t
  modified_base (1321)..(1321): a, c, g, or t
  modified_base (1343)..(1343): a, c, g, or t
  modified_base (1348)..(1348): a, c, g, or t
  modified_base (1350)..(1350): a, c, g, or t
  modified_base (1359)..(1359): a, c, g, or t
  modified_base (1364)..(1364): a, c, g, or t
  modified_base (1370)..(1371): a, c, g, or t
  modified_base (1376)..(1376): a, c, g, or t
  modified_base (1883)..(1883): a, c, g, or t
gtgctttatggcgaaggatggagtttngctcttgttgcccaagctggagtgcaatggtgcgatcttcgcttactgcaacctctgcttcctgggttcaagtgattcccctgcctcagcctcccgagtagcagggattacagatggagcctcgctctgtcacccaggctggagtgcagtggcacaatctcgggtcactgcaacctccgccccccagcttcangcgattctcctgtctcngcctcccgagtagctnggattacaggtgcacgccaccaggcctggctaatttttntatttttngtagagatgggnttttgccttgttggccnggctggtctcnanctcctgacctcaggtgacccatccnccttggcctcccaaagtgctgggactacaggtgtgagccaccatgcctggtcccccacttgttgattttgcagaaaagatagctgtgttacaacctgtcctaaggtcaggtatgaatacttgtgcttctttcttggctccccaagccagagggcattcctatgcccaggtgagagagcacggagtgttactttggcagcacagtcagttaccagaggtaggaaaagcaaaggccaggcaggacatgaggggcccttgcactggctggttctccctgccttcaccaccctccaggtgaatgactgggtgaataatgattgactgaggaggtaatgaataatttatggacactgctggacctcagtctcctcatntgaaagatgagtggttggagaagtttaatggttttcaaatgctttttttttcagtcttcaaataagtgtttacgtagaagcaccatatctgaaacaggtgacagtggaccagtctgaatgaaatgagggttggcaggcctgagctccaaaaccttctgattgcccaagccctccttgtcttgcttggattatctccacacaaatggagaaactggacaaggtggtcatggaggtccctgaaagctcaaagactttctcattccaggattccccatgttcatatgccagcatggcatgggggtgctctgtagtcaagcagggtcctttggggggcttagggatggagccaggaaatggctctgggactcagcgggtgtccagagtctcatcagcagggtttctttactttcactgagtggctggtgcctgcacactgagttttgcaggcttactctcacagagtgagcttcctgcaggcccccnactgcancccntttcnntnnnnnnnnnnnnnnnngnnnnntnnntnnnnnnccnngnccctctcccnatgctgctgantggncagnctttctntgncncgctcgtggttgccacagtcancgctngntaaaattgntgatncagatnngcctncccagctgcgagtgctggcacgggaccagcagcccagacggtcactggaagtggttgggctgattattggcatcatctccattgtcctactcggttcttaaaggcatatggacttgcctcactcctacagcaaatgacggcatgggcaaagaggggcaacagacccaccctgaagacactcctcatctggttgacttggcagggttaagggaaaaagatgtgatgactaggagctgagagcttagtggttctgccagagctgcagagtctttgttggcctcagggtgggacctctcacatctctgtcagcttttcacagacaccaacctgttatgattcatttcacctgtcctgagcactagcaagaaaaattcgctgtagcttgtgatgtattattctggatttctcaactcattcatttgttcattcattcactataccattactgtctattataaggggggcacaatggtaggtgctgggaataaaaacgatgtttaacgtttnaaaaaaaaaaaaaaaaaaaaaaaaaaaaaaaaaaaaaaaaaaaaaaaaaaaaa

SEQ ID NO: 256 - DNA, 612 bp, Homo sapiens
  modified_base (51)..(53): a, c, g, or t
  modified_base (543)..(543): a, c, g, or t
  modified_base (546)..(546): a, c, g, or t
  modified_base (548)..(548): a, c, g, or t
  modified_base (550)..(550): a, c, g, or t
  modified_base (558)..(558): a, c, g, or t
tacggctgcgagaagacgacagaaggggcatctcgacatcgatacgacttnnnttttttttttttttttttgcttcaatacttctgccgctttggaaattgtaacagttaattactttgaatgttgctaaaaggacattttgtgtagggtcaagttatttttatatgagttaatgtgaaattgtaaatggaaatttttccttaaaatacaacacaatgatgtctgtataaatctgtctgtttagaatctgtgctgtgtaagggcattcgtactcatgctgttactgtacttatgcaccattcagacttgttagagtagatgtgggtttatgactgccaagtttgcccagtacagtagttttttatcactaaaagttggactcattgatggagtcctgtagtagtttcagtgttagatacagttttttccaccatacatctgtgcattttctctttaggtgactgtttaagaaatttgtgtgcatagttactcagtttttatgaactgttgtatcctgttaatgcatattgctctgtgactccngtnanancttacctntactgaccatacctaaataaagatttttattgtaactccaaaaaaaagtcgacg

SEQ ID NO: 257 - DNA, 1192 bp, Homo sapiens
  modified_base (155)..(155): a, c, g, or t
  modified_base (159)..(159): a, c, g, or t
  modified_base (513)..(513): a, c, g, or t
  modified_base (585)..(585): a, c, g, or t
  modified_base (649)..(649): a, c, g, or t
gtgaaccgaagtccttatattcccgggcttctttctcctctgggtaccagctccttactgccctgcagacaagcgtgccgtgcgtgcttgtggccaagggaaggaagagctggttgatccacagatagctccttcctccccgccccttccttttngttnggaggtcccaggatctgtgttcacagacatctgggggaagaaaaggagcaggaaactaccccgcacagagttaagcaggaaacaacaacaacatcatgcaaaaaccctgcaaagaaaacgaaggaaagccaaagtgcagcgtgccaaagagggaggaaaaacgcccgtatggagaatttgaacgccagcaaacagaagggaattttagacagaggctgcttcagtctctcgaagaatttaaagaggacatagactataggcattttaaagatgaagaaatgacaagggagggagatgagatggaaaggtgtttggaagagataaggggtctgagaaagaaatttagggctctgnattctaaccataggcattctcgggaccgtccttatcccatttaattaatttctctgacaattcaattatttnctgttattaatgttgccactgctttctgtttgtctgcactttcttgataaatatttgctatcgntttactccagtcattcgatgttgctgagatttacatatgactcttgtcaacatctcatcttttgacccaatcttattcatttaataagaggtctcattcatttgcatggaaaaatgctcattgtatattgcaaagtgaaaataacgagttgcaaaacagtgtatacatatatgtgtgtatatatgtacactttatttgtacatttctatgtgacataatgcaaaggaaagtgtctgattttattatacaccaaaggttaacagtgaatctctgtgtgatctctttttttttctttttgcctatctgcatcttctcacttgccaaaaaatgaatatatgtttatgtgtgtatattacttgtgtcacaaaaaaccctaaagtagacagtaaaagaacttgtcaatcgcctttggaaggcaatgaaacacttaataaactctcaataacagaagcgtaaaaatgaaatgtaaacctccaattacctctggatctcttagccagagtaataaactggtaattattacagataaaaaaaaaaaaaaaa

SEQ ID NO: 258 - DNA, 784 bp, Homo sapiens
  modified_base (519)..(519): a, c, g, or t
  modified_base (540)..(540): a, c, g, or t
  modified_base (684)..(684): a, c, g, or t
  modified_base (687)..(688): a, c, g, or t
agcggccgcccttttttttttttttttttttttttttctagtatgtgctaattatgaattttattaaggtttattcaatgtcacagaggaaagaacggtttgtagttttgcttacccgcagtgctggcaggtcacagctgtccaaccatgatccattcacatgctctggccccgtgcccctcgtcctcccacccctaccccacaggacaccattaagccagggctgggtaacaacatatgctcaatgcatcttctcaggtgagaaccaaactcgagccacaacagcaaagggggaaaaaggtagcaaagtaattatgtgctcccaaggcagtcatttagttgaatccataactggaaataaaaaggcatttatgaagtgtagtccgcagtctgaatgtggaaggtggaagatcacacatttactaagaaacactcaaaacatattttggttcagaattctaaaaaatcccgaattttccatgatcttcccaagacaaccaatgacccacttaaatttanggcaaaaacacccttgaatcnaggaatgtgcacatatgcaacagctaacatctggtaactctaataatgttccttatatgtttctgtgtttactatcatgaaccataggaagaagtactggaaaatttagtaagtgtggacagttaaaaacactggcccggcacngtnngcacgcctgtaatcccagcactttgggaggccgaggtgggtggatcacgaggtcaggagttcaagaccaggcataccctctacacttataaaaatg

SEQ ID NO: 259 - DNA, 865 bp, Homo sapiens
  modified_base (21)..(22): a, c, g, or t
  modified_base (24)..(30): a, c, g, or t
  modified_base (32)..(32): a, c, g, or t
  modified_base (35)..(42): a, c, g, or t
  modified_base (98)..(98): a, c, g, or t
  modified_base (114)..(115): a, c, g, or t
  modified_base (233)..(233): a, c, g, or t
  modified_base (388)..(388): a, c, g, or t
  modified_base (479)..(479): a, c, g, or t
  modified_base (498)..(498): a, c, g, or t
  modified_base (504)..(504): a, c, g, or t
  modified_base (514)..(514): a, c, g, or t
  modified_base (843)..(843): a, c, g, or t
  modified_base (845)..(847): a, c, g, or t
  modified_base (850)..(853): a, c, g, or t
gggtctctataatcaataacnngnnnnnnnanatnnnnnnnnataaagatattatatataaatataaatttacatatatatgcacatgtatatatagntgtacatatatgtgtnntatatatatacttaaatgtaatatttacaaaataaaactgtgatctcgtctagagaaaatgtattcatattacaaactgctcttccatatttatgtaccatattatacctttttattnttgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaangaaaaagaagaaagacacaaagaaaataatctaaacaccaaaaactaaacacaattccaatcctttttctgtacctcacgcgcataaattngctgctcctattttttttnctgttnatgtgttttnatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgcttnannnaannnntccggctcgatt

SEQ ID NO: 260 - DNA, 888 bp, Homo sapiens
  modified_base (130)..(140): a, c, g, or t
  modified_base (142)..(142): a, c, g, or t
  modified_base (208)..(208): a, c, g, or t
  modified_base (236)..(236): a, c, g, or t
  modified_base (263)..(263): a, c, g, or t
  modified_base (282)..(282): a, c, g, or t
  modified_base (289)..(289): a, c, g, or t
  modified_base (321)..(321): a, c, g, or t
  modified_base (345)..(345): a, c, g, or t
  modified_base (354)..(364): a, c, g, or t
  modified_base (366)..(366): a, c, g, or t
  modified_base (839)..(839): a, c, g, or t
  modified_base (841)..(851): a, c, g, or t
  modified_base (853)..(854): a, c, g, or t
  modified_base (857)..(861): a, c, g, or t
  modified_base (864)..(864): a, c, g, or t
  modified_base (866)..(866): a, c, g, or t
  modified_base (868)..(869): a, c, g, or t
  modified_base (871)..(872): a, c, g, or t
tttttttttttttttttttttttttctatagtaataggttctcattttattcaataaactataatctaccattatcattattaatttggatgctcacatcatcccaaatttggccactggaagccccttnnnnnnnnnnnangtgtcctttgacatgtccctgtcattttttaaatgcttccttgctttctggcaccacacagcactntgggctcaccttgtacttccctaccccngccttagcatcagccatttctacaagnagctctgagtccttttagngaagggnggtatttataaaccacaatctggatggtttgnggatattgcacagcattcagtcanaagccatgnnnnnnnnnnntnggaaatgaagcgacatttattgaaacttgtattagtcaagcaacttaatgctaggctaagttgcagtgagtaataatccctaaccccagtgacagtgcagaaaaagaagggtttcatatgtggagtgtgatgcatgtcaatgggagtttcctccacctggtgactcaggtatccaggcacattcatctctgcaggtctgccatcttgacacgaggtcattgcagaaggagagagggtgtagagtcatgccagttcttaggtgctcctgacaaggagatctgcagcactctgctcacattcctgttttccagaactcagccagtacccagtgcaactgccaaagagtcttgcaggacggagtcttggccgcagactgagcctgtacctcacccgtctcccaccaactcttggtactggacgcagtcatgctgggcagctctatggaggcctggcgggctagcttgggggtctgncnnnnnnnnnnntnncannnnnggngngnngnntgggcctgaggtctcc

SEQ ID NO: 261 - DNA, 1001 bp, Homo sapiens
  modified_base (17)..(17): a, c, g, or t
  modified_base (471)..(471): a, c, g, or t
  modified_base (475)..(475): a, c, g, or t
  modified_base (484)..(484): a, c, g, or t
  modified_base (490)..(490): a, c, g, or t
  modified_base (501)..(501): a, c, g, or t
  modified_base (535)..(535): a, c, g, or t
  modified_base (679)..(679): a, c, g, or t
  modified_base (985)..(987): a, c, g, or t
ttttttttttttttttntggaagtaatgtctgtttattgatagaaaacaggccacgtccagagaggcccagggccaaaacctccttctggaaggccgaagtcccacagtgccggggagcgcaggagtcagctcggctccgtcttgccagggctggggggaccctcatcctcacccgcttccggagctgcagtggatgtgggggcccctgcagcctccagaaccagttccagggccccctcgcccgccacacggtgcacctgctcgcctctggccgtcaggatctcttcgatatttctcttcccattcaggtccgagaaccagcccaggttgtcagcgatgatatggtggttctggcagccggggcaggtcacaatgaccacgccttggtgataggccagcttggagatgcgcttggaggacctagtcccgcagaccttgcaggtgtagacgagctggtagtgcgccgcctncacngcgccccangagccnccgcgggcccnggcccctgctcggagcttgagcgccgccagcccnaggcccaggcccgccgcctccccgcgacctctggacgggccccgcggccccacagccgcctcaggcagggcgcccggggctgcacgcgactcagcaacctcggcgcgccgcgcagcgcagtccgcagcatcccgctcgccggcnccgtccgccctgccccggccctgccccggccccgccccgccgccatcttggaagtgggcgccgggcggaagcggcgttcttgggcttccgtcttccgggtcgggggcgcgctgcgctatgccgccccctggcggcctgagggggccctgcgtccacgtgcagctcgcaccccgaggacaccgcgggccgcagcgaggagggacggccgcggggctgcgcgcgagtgtccgagcgggaatgcgggtcacccgtgctgtttatttacgcagctgtgttttctaacactaatacaatgcatgcatgtannntgtgttacatggtg

SEQ ID NO: 262 - DNA, 867 bp, Homo sapiens
  modified_base (2)..(2): a, c, g, or t
  modified_base (6)..(6): a, c, g, or t
  modified_base (134)..(134): a, c, g, or t
  modified_base (158)..(158): a, c, g, or t
  modified_base (495)..(495): a, c, g, or t
  modified_base (569)..(572): a, c, g, or t
  modified_base (609)..(609): a, c, g, or t
  modified_base (618)..(618): a, c, g, or t
  modified_base (634)..(635): a, c, g, or t
  modified_base (639)..(639): a, c, g, or t
  modified_base (645)..(645): a, c, g, or t
  modified_base (670)..(670): a, c, g, or t
  modified_base (679)..(679): a, c, g, or t
  modified_base (692)..(692): a, c, g, or t
  modified_base (702)..(702): a, c, g, or t
  modified_base (710)..(710): a, c, g, or t
  modified_base (724)..(728): a, c, g, or t
antganttaaagagatgaatttattggtaaatagataaaattaacacctattttaatatatccaaaccccttccttatatatattaggtaaattaaaagaaaaaaattatcaaagcaatactacagccagctanatcgccaatttacaaatgagttangtaagtaccataagtttgtttgaatatcaggtgcttcagagtttttctcaaacagttacaaaagagattaggttcccaatcagttcacaaaagctaatttaaagaatgtagcttaactacagtactgaggttgtcacacacttaactttcggtctcttgcttatttattcatatctgaggttcactgtttctactaggatacattccgcccacacccacaccttggtccccacatcaagcagctcctcacagcaggaagacatccgctatcagacatggttttctgaagttgtgcttaggatttcagaggaggaaaaattcagaggttctaatagcnttcggtaactgaggtagaatatggggctcccaagaatatcttccatatgccccaaatctgtttccctcccaccnnnntccagctctgttcaaggtcaagtttgagaaagatacntgttctcanatggtatatttttaannatcnacatcnatttttaagagactacctgctaaanggagaatantggctcactgcantcttttctcnaccccctnaactattttaaaannnnntggcagggacaggtgccatgctcacgcctgtaatcccagcactttgggagccgaggcgggcagatcacttgaggtcgggagtttaagaccagcctgacccacatggagaaaccccgtctccactaaaaataccaaatta

SEQ ID NO: 263 - DNA, 1896 bp, Homo sapiens
  modified_base (2)..(2): a, c, g, or t
  modified_base (190)..(190): a, c, g, or t
  modified_base (475)..(475): a, c, g, or t
  modified_base (499)..(500): a, c, g, or t
  modified_base (515)..(515): a, c, g, or t
  modified_base (623)..(623): a, c, g, or t
  modified_base (706)..(706): a, c, g, or t
  modified_base (730)..(730): a, c, g, or t
  modified_base (757)..(757): a, c, g, or t
  modified_base (775)..(775): a, c, g, or t
  modified_base (786)..(786): a, c, g, or t
  modified_base (788)..(788): a, c, g, or t
  modified_base (793)..(793): a, c, g, or t
  modified_base (812)..(812): a, c, g, or t
  modified_base (832)..(832): a, c, g, or t
  modified_base (957)..(957): a, c, g, or t
  modified_base (1768)..(1768): a, c, g, or t
  modified_base (1856)..(1863): a, c, g, or t
gnctggctccttgaggggaggtgcagctttcatctgaccatgcaggcgtgctttgcagtgggtagagcagtgctttcctcctcccagctgcacactggaatcacctggagagtccagaaacttcccgcctcagtgaaagaacatcagtgtatcagcacagcaaatattccaaatgccaggctggattccntccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggtttctcctctgagccaccttaaggaatcccaccctgacccggtcagagctcaccatgcctccctctcctacttgctcagcattttgtgtctatctagactnaagcctttgctttctctctgtganngtggtgaaagttcantttgctttcctatctctagaatgtcagcacgaaggcagaggcatggtctcctgagttccataaccccaaagcctaactccctgcctgccacactgaggggcttagtanacattgacttactaaattgaatagttgagtaataatgctctttgaaataatttggagttagatcttgagccttgtgtggccangaggatgggtgaggacacatcatnaaaactaaaggtaactgagcatgccangtggttggggtgagaaanttgcatggagnantccangacacagaggcagcaaaancccaagtgctgggaagtcangagtgagagagtgaaggggcagtgagtgcttctttaggagctggatcaaaacctaagatgatctggccacatggtgcagactgagcacacacttgggagagaaatgggccaggaggagaggaganaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactctgccacaaggcacctgggctcctaaatgaccaatacacatgtgctatactggtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccagctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggntgatcaaatgtacaaaatatgcatgatggcaccatattgtgtataatagtgacaaatacagtctatgtgggtggagaaacaaaaaaannnnnnnnaaaaaaaaaaaaaaaaaaaaaaaaaaaaaaaaa

SEQ ID NO: 264 - DNA, 560 bp, Homo sapiens
  modified_base (518)..(518): a, c, g, or t
  modified_base (520)..(521): a, c, g, or t
  modified_base (525)..(525): a, c, g, or t
  modified_base (544)..(544): a, c, g, or t
atacctgtctccattcacatttacctgggaccagggtgggcaggagacaccaggtcatggctcctgagccccggccccctggactgaagggacagtgtgtgagaatcagttctgtgaagggcgggaggaagcagtcacctattcctcctgccttcacagttaaggtgaaaaccttagccctatccttgattcctgggggctgccgggccctgtgtgctcccctgcacacctgggtgcctttctgaggctggcagcagcggccggggtcaggggtcctgggctcctaggctcacacctcagctcacagttgcgtccttgcaggaggacactgggtgtctgacaaacacaaggcctcgacagcaggtctggaactttcaaccccagcaggatgagggggaatgggggtggatgtcaggtaagtaatttctggtcccactacaaaactttatttttgattagagtaccattctcaatctcttctacaaaaagcaaaaaaaagcaaaaaaaaaaaaaaaaanannggcngccatttcactcatttcangacctatatccttgta

SEQ ID NO: 265 - DNA, 804 bp, Homo sapiens
  modified_base (215)..(216): a, c, g, or t
  modified_base (220)..(222): a, c, g, or t
  modified_base (738)..(738): a, c, g, or t
  modified_base (743)..(743): a, c, g, or t
  modified_base (745)..(746): a, c, g, or t
agccatgagacccttaggttaattagggcatccaaaattaccttttgggaaaaagccctaaaggggggccccaagccctggattattttccccggggcgagaatttcaatatcaagctttttggatcccgggtcccttaagtttttttttttttttttttttttttttttttttttttttttttttttttttttttttttttttttttttttttnntttnnntgaatttaagactttactttattcagcaaaatcatttatttacacaatggggaatgctggtttgattttgtcaatgaaataaaaacaaaatgaacagagacaatactgaactgtatatatactttgtatcagagttgaccaactgtttccttacctgtatcaggaacatcaagagcaacagtatcacaaggacactggtttaacaatacaccacataggtccagtaataccctgggaatttcccaatgcaatcaccaactttttctttttttataaatatataaaaaaacaaaaagtcagcaaaaccagcattatgatgtagcaaacagagtataactctgaagtcagtggggtcagtaaaagccttatcagaccatccatagttttacaatgtgatctgctcttcctcagaccactaatatagaatccaaacaggtgaaaaatacgtcactccttagaatacaacaatgatctgataaggatttgacttagtggaaggaaaaaaaaaaaaaaaangggantnncagagcatagcccctattagaacaagctaactttccagattttacaaattaaaaaaac

SEQ ID NO: 266 - DNA, 1207 bp, Homo sapiens
  modified_base (193)..(193): a, c, g, or t
  modified_base (639)..(639): a, c, g, or t
tgtgtgtgtgtgtgtgtgtgtgtgcgcgcgcgcacgcacgccttgagcagtcagcattgcacctgctatggagaagggtattcctttattaaaatcttcctcatttggatttgctttcagttggttttcaatttgctcactggccagagacattgatggcagttcttatctgcatcactaatcagctcctggnttttttttttttttttcaaacaatggtttgaaacaactactggaatattgtccacaataagctggaagtttgttgtagtatgcctcaaatataactgactgtatactatagtggtaacttttcaaacagcccttagcacttttatactaattaacccatttgtgcattgagttttcttttaaaaatgcttgttgtgaaagacacagatacccagtatgcttaacgtgaaaagaaaatgtgttctgttttgtaaaggaactttcaagtattgttgtaaatacttggacagaggttgctgaactttaaaaaaaattaatttattattataatgacctaatttattaatctgaagattaaccatttttttgtcttagaatatcaaaaagaaaaagaaaaaggtgttctagctgtttgcatcaaaggaaaaaaagatttattatcaaggngcaatatttttatcttttccaaaataaatttgttaatgatacattacaaaaatagattgacatcagcctgattagtataaattttgttggtaattaatccattcctggcataaaaagtctttatcaaaaaaaattgtagatgcttgctttttgttttttcaatcatggccatattatgaaaatactaacaggatataggacaaggtgtaaatttttttattattattttaaagatatgatttatcctgagtgctgtatctattactcttttactttggttcctgttgtgctcttgtaaaagaaaaatataatttcctgaagaataaaatagatatatggcacttggagtgcatcatagttctacagtttgtttttgttttcttcaaaaaagctgtaagagaattatctgcaacttgattcttggcaggaaataaacattttgagttgaaatcacacagtgtaacttgcaaaaagattccatctctgagatccgaaagacttttaaggttatcagtccaatgaacccctggtgtaacaagaagtcccatgcttttgtcattaggcgggt

SEQ ID NO: 267 - DNA, 818 bp, Homo sapiens
  modified_base (2)..(7): a, c, g, or t
  modified_base (52)..(53): a, c, g, or t
  modified_base (74)..(74): a, c, g, or t
  modified_base (121)..(121): a, c, g, or t
  modified_base (125)..(125): a, c, g, or t
  modified_base (616)..(616): a, c, g, or t
  modified_base (751)..(751): a, c, g, or t
gnnnnnnctttttttttttttttttcagactgaccgcggggcagctgcggannatgtcgaccccggcccggagnaggctcatgcgggatttcaagcggttacaagaggacccacctgtggntgtncagtggcgcaccatctgaaaacaacatcatgcagtggaatgcagttatatttggaccagaagggacaccttttgaagatggtacttttaaactagtaatagaattttctgaagaatatccaaataaaccaccaactgttaggtttttatccaaaatgtttcatccaaatgtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgnagaaaaaaaagaaaaaagtccttcagtttagaacctacaaaagcttgtgtatcttgattaatgtactttttattgcatggtgtgaactaagttattgctgcataaatttgtaatatatcctgtttgtattttttncaagtgtataatgttggtgtggagttttcatgacagaatatacacattttgtaaatctgtacttttt

SEQ ID NO: 268 - DNA, 771 bp, Homo sapiens
  modified_base (25)..(25): a, c, g, or t
  modified_base (102)..(102): a, c, g, or t
  modified_base (615)..(615): a, c, g, or t
  modified_base (620)..(620): a, c, g, or t
  modified_base (628)..(629): a, c, g, or t
ttttttttttttttttttttttttnttttttttttttcaagttgacatgtgtatttattgcacaaatatcccctagaactgggaggttattataatacaagngtacatttgagaaatgtatacagaacaagaaacagctatgtacatatccaacatctaagtaacttagaaaaagcagaacaatctcataagacatctaccagaagtaggcattatgtaaaatctgtttttttaagtgatcatccccagagtatgccaattggaacaaaacaaaatctgtactagtatgtttttattgcacttaacattttcaaactcaaaattaagacatattaataaaagccagaaatatttaaaatcaaaccaattagtttatatacaagaaaaaattagttttaattctataatgtaaaagatcccttttttatttcctgtttcaataaacaggttttttttgatatgtaacaactgtctgtaccataacttgtaaaaattatttagaacaagccaaaactcttttcacattcatcataatgaccacactttaaagtagcagcagctcattccttgggctttgcgtaaggaaagaatgactatggtgaaggtaatagaaanttatngaaggatnnggatttacaaactcaggattgggaaccgtggggaggaacaaacaataacttaggaatcctttagggtttaggttttttaagaaacatatggaatttccttcccacaaagttacttttggaccaaattcttgggccccctttt

SEQ ID NO: 269 - DNA, 484 bp, Homo sapiens
  modified_base (10)..(11): a, c, g, or t
  modified_base (138)..(138): a, c, g, or t
  modified_base (166)..(176): a, c, g, or t
  modified_base (179)..(180): a, c, g, or t
  modified_base (265)..(280): a, c, g, or t
  modified_base (282)..(283): a, c, g, or t
  modified_base (441)..(441): a, c, g, or t
gcggccgccnnctactactatacggctgcgagaagacgacagaaggggaggatgaggcaccattccaggagaaagattccggcagcgatgaagatttcctaatggaagatgatgacgatagtgactatggcagttcgnaaaaaaaaaaaaaaaaaaaaaaaaaaannnnnnnnnnngannaaaaagaaaaggaaatgcccaaacccagactaaaggctacagtgacgccaagtccagtgaaaggcaaagggaaagtgggtcgccnnnnnnnnnnnnnnnnannatacggctgcgagaagacgacagaaggggaggatgaggcaccattccaggagaaagattccggcagcgatgaagatttcctaatggaagatgatgacgatagtgactatggcagttcgaaaaagaaaaacaaaaagatggttaagaagtccaaacctnaaaaaaaaaaaaaaaaaaaaaaaaaaagtcgtatcgatgtcga

SEQ ID NO: 270 - DNA, 862 bp, Homo sapiens
  modified_base (151)..(151): a, c, g, or t
  modified_base (646)..(646): a, c, g, or t
  modified_base (693)..(693): a, c, g, or t
  modified_base (702)..(702): a, c, g, or t
  modified_base (710)..(710): a, c, g, or t
  modified_base (716)..(716): a, c, g, or t
  modified_base (718)..(718): a, c, g, or t
  modified_base (721)..(722): a, c, g, or t
  modified_base (724)..(725): a, c, g, or t
  modified_base (737)..(737): a, c, g, or t
  modified_base (744)..(744): a, c, g, or t
  modified_base (746)..(746): a, c, g, or t
  modified_base (753)..(753): a, c, g, or t
  modified_base (767)..(768): a, c, g, or t
  modified_base (772)..(772): a, c, g, or t
  modified_base (774)..(774): a, c, g, or t
  modified_base (781)..(782): a, c, g, or t
  modified_base (784)..(784): a, c, g, or t
taattaaaaacttttttttggaaacctttgggaaaattttttttttttttttttttttttggtcaagcttgaggctgaataaagcctttgatgcacaaaatgggactgctgaagagtggacagttggaccttactttggtgaccccatacntttgtggtcacatgctttagccatacacatggtaacattgactatggagtcttgtgaaagtgtaatgtgcgatggctatgtagacataaagaagaaacttgtaaatatcttttttcttttttttaatgtttctgatttctgaagtgcttgtatagcttttatctgcggctttaaactgacagtacccgactgtttattggatctattgatttgaaaagaatttgttaggatagatcttaagcagtaatctgtcagtgtttgtatttgtattctctgcaattttactgtgaaaaaaaatttgttttcaacaattggtgtcattttcttgatgtcactatttgttggagagttaaatggtctcttccctttgtgtatcttacctagtgtttactcctgggcacccttaatcttcagaggtgctaaattgtctgccattacaccagaaggatgcctctgataggaggacaaccatgcaaattgtgaaatagtcctgangttcttggattactttacacctcagtattgatttgtcccagaatttnctggccttncatggcantgaaantnttnngnngaaagatttaangtatttnanttttaangagtgtgttataannatantngtactgnntnctttatcccattttatcatcctttcagtttttattaatctactgtatcaataaaattctgtaatttaaaagagaaaaa

SEQ ID NO: 271 - DNA, 957 bp, Homo sapiens
  modified_base (18)..(18): a, c, g, or t
  modified_base (118)..(118): a, c, g, or t
  modified_base (126)..(126): a, c, g, or t
  modified_base (157)..(158): a, c, g, or t
  modified_base (182)..(182): a, c, g, or t
  modified_base (226)..(226): a, c, g, or t
  modified_base (256)..(256): a, c, g, or t
  modified_base (264)..(264): a, c, g, or t
  modified_base (272)..(272): a, c, g, or t
  modified_base (278)..(278): a, c, g, or t
  modified_base (283)..(283): a, c, g, or t
  modified_base (286)..(286): a, c, g, or t
  modified_base (290)..(290): a, c, g, or t
  modified_base (306)..(306): a, c, g, or t
  modified_base (309)..(309): a, c, g, or t
  modified_base (368)..(368): a, c, g, or t
  modified_base (887)..(887): a, c, g, or t
agcgctttggaaagacanaatctagaacactactagcagacaaaaaattacctgcaactggatagcgtaagtgcagtatagcgagacaaaacatatattcatatgttggcttgtttangcctcaanccctcgaccctttgttgagatcccataattnnattcctatgattttaataactcangttccaggaggactataagtctaatttgtactccaaaccaaacngcagtgcagttcgctactactgaggctgantctgtacngacttcangaccangtccngangacngttattatctaaaaantanttacttgaatacatagatgatccttcagagattttacctataacctatttcttgatganggttatttaatgcactggagataactgtgacttactgatcaaatacttgaatacttatacttacctgggatttcatttctgctgaaagaaataggaagaacaggactcacttaaaaaaaaaaaaaaaaactttagaaaggaaggtaaaaatcttacacacactatcacttttggaagcagcatagaaggggcagtcaagggtaaaacactggtgaaacaggtcaaaattaggaaaaaaaaaaaaactatattattatcaatgacagtaccacaactgtgcccttgataattagtaatcactcctaaaaatcttcatttggcaccagatggtgtgtttaaaacaccctaggatgttttgaatcaggcttgattttgttagttgagttacaggagaattttaagggtgagggtatgggggtcagggaagaaaaggaaatgggaaatggaccagaaaaaatcttgagtcatcatctaaatcaacaaagcactgatagctccaaatattaggtcagacactanaacgactgatataggctcaagtggtttataaaacctataaaaagactacaccagcagagtccctgtcaat

SEQ ID NO: 272 - DNA, 485 bp, Homo sapiens
  modified_base (10)..(10): a, c, g, or t
tttttttttngcagtttttcctgtttattatatagttattctaaggtggtaagtgtcacaaagttaacttcaagaggaataacatggtccagtgtgaaacacaaggtacaacattttacaatgaaaccacagcacaaagtaactgaactttcaaaattgggtagttcaatgaaacattttgtcaacccttagctctataaagctctgctgatggacttagttgatggatttaaaaaatatattgctgtgtcaaatgttttaacacaaaatgtttttttttaaagagaatacacatccaatcaactgaaactgtgagcagaaagtatgtaacctctttataaaaacgttatccaaatttacaacattcataatatatttcaaagtaaagagttcttagaaaaaataaactcaattccttgcttactgatgagtatcaactcctcaaaaacacatcacagaaagttaactttcatacttctttgcct

SEQ ID NO: 273 - DNA, 685 bp, Homo sapiens
  modified_base (3)..(8): a, c, g, or t
  modified_base (19)..(19): a, c, g, or t
  modified_base (487)..(487): a, c, g, or t
  modified_base (520)..(520): a, c, g, or t
  modified_base (572)..(572): a, c, g, or t
ggnnnnnnttttttttttnttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtanaagtaaaaactttaccatgcctttttttttttngttggcctaacattgaggccttaaaacctgaggctcctgtgcctgatggaantcttgtaacatacacttgtgtatcatataaagataccactctgtttctcttatgtattcttactctagttgtttattaagaatgacaagcacgtcttttcaaaaaaaaaaaaa

SEQ ID NO: 274 - DNA, 570 bp, Homo sapiens
  modified_base (75)..(77): a, c, g, or t
tttgtttttttttttttttttacaccataaagtgattattaagctttcctttttactctttggctagcttttttnnnttttttttttttttttttttaattatctcttggatgacatttacaccgataacacacaggctgctgtaactgtcaggacagtgcgacggtatttttcctagcaagatgcaaactaatgagatgtattaaaataaacatggtatacctacctatgcatcatttcctaaatgtttctggctttgtgtttctcccttaccctgctttatttgttaatttaagccattttgaaagaactatgcgtcaaccaatcgtacgccgtccctgcggcacctgccccagagcccgtttgtggctgagtgacaacttgttccccgcagtgcacacctagaatgctgtgttcccacgcggcacgtgagatgcattgccgcttctgtctgtgttgttggtgtgccctggtgccgtggtggcggtcactccctctgctgccagtgtttggacagaacccaaattctttatttttggtaagatattgtgctttacctgtattaacaga

SEQ ID NO: 275 - DNA, 682 bp, Homo sapiens
  modified_base (412)..(412): a, c, g, or t
  modified_base (500)..(500): a, c, g, or t
  modified_base (514)..(514): a, c, g, or t
  modified_base (522)..(522): a, c, g, or t
tggttgttttgaaaaacccccatatttttgggaattttttttttttttttttttttgataagttggtgtaaggctatgtgacttgatcaaaacagatgcagggcctctaaataaaagggatcatctgaaattaatgttgtttgaaattactatctgattttgagggttccagtatttctgtgaaaattcaacaagaactccttggaaactggtattgatattcagtctccttaaggtagatttttcaagcttttcatacattggaactccacctgactttggaccaaccccagaacagagcagagccacctcctatagacgcccattgccctgctgctgtacacttcagcagcttgcacaagggagctcacttaaaaggagaaattgtgtagttttaaaatatattttgtgnaaaataccttactatgctataaaccaccattaaaaaccagtgttttgatttggtacttaaatatttttggagtgaaaattatcactanagtaacatgactcncaacaaangtatggtttcattataaaagagtactgtattgatttgcccaagttttgtaacttagtaaaggtattaacttccttggatttgtactttgtgatttagtatgctgtatcgtgggctggttatgttaactgaaaaaaataaagtcattacctgagttttgca

SEQ ID NO: 276 - DNA, 500 bp, Homo sapiens
  modified_base (4)..(4): a, c, g, or t
attngtgttctgggtttttttttttttttaaccaactcaatatgtgtttgatgatagtgaattgataaaacccgaagcttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcattaaaaaaaaaaaaattctttacagtcaacccaagcttaacatggactcaggttccccagcagccttaatttgttttgttaccatc

SEQ ID NO: 277 - DNA, 405 bp, Homo sapiens
  modified_base (12)..(15): a, c, g, or t
cacgaggttttnnnntgcttggtaaacgaaaagcaaacttctttattgtacacagtacagaatataacgcagcttggcaggatgcatacggccctgcgcaggggaaagtatttcaaatcagctggcaggttcaagcctttctgcactgtagactttccacactctggaaaagaagcaaacaaacaaaccccaaagaacccccgaaaaaaacaaaaaccatccgggaggtgcatgagtccaatgggaatgcaaccgtgatgccgctgtcctatgcccagtgacagcacaggtcacgtaagttacagcaggggaggggtagctcaagctacagaggattattgtcatattgctaagacagcataaatccattcaaaaaaaaaaaaaaaaaaatccaaaccagggtaa

SEQ ID NO: 278 - DNA, 793 bp, Homo sapiens; identical to SEQ ID NO: 67
  modified_base (618)..(618): a, c, g, or t
  modified_base (632)..(632): a, c, g, or t
  modified_base (661)..(661): a, c, g, or t
  modified_base (678)..(678): a, c, g, or t

SEQ ID NO: 279 - DNA, 588 bp, Homo sapiens
  modified_base (8)..(9): a, c, g, or t
ttttttanntttaaaatacatttccatttttaatttaaaaaataaataacagcaaatctgaacaaaattttcctacttcaatgcacatcttcctaactgtccatgtttgaaatccagatagcaacaaaatcatggcaaaggcatttttgacaaagtttagacaaacgactcacaaaatatggctaatagtagatgagtttggacatctgatactgcagaccagccttggctagatcctaggcgtcagagtgaaatcatgaatttccttttgtagattagaattgatggtccaactctcaacccaccaaagagaaacttaccttttccaatttaattgtaaaagccagatatatcactgaatgaaggtatctaaggaagtgatatttatcaacttcccaaatgatacagagaaggaaagcataattattaaaatgaacctaaagtctagatacagtgggccaggctggtgaagccttagactactatggaaatgacattgtttataagatgttgcacaaattatggtaatctgtgtcaatatttcaatgtgtgctggattattactgacatattcataattttaatgtc

SEQ ID NO: 280 - DNA, 703 bp, Homo sapiens
  modified_base (457)..(457): a, c, g, or t
  modified_base (459)..(459): a, c, g, or t
  modified_base (464)..(464): a, c, g, or t
  modified_base (467)..(467): a, c, g, or t
  modified_base (471)..(471): a, c, g, or t
  modified_base (479)..(479): a, c, g, or t
  modified_base (481)..(483): a, c, g, or t
  modified_base (485)..(485): a, c, g, or t
  modified_base (490)..(490): a, c, g, or t
  modified_base (495)..(495): a, c, g, or t
  modified_base (498)..(498): a, c, g, or t
  modified_base (514)..(514): a, c, g, or t
  modified_base (517)..(517): a, c, g, or t
  modified_base (530)..(531): a, c, g, or t
ttttttttttttttttggataactcagtttcagataaaccatcttggttactgtgcttaatttggaccaaattttatttagcttaatatggacactgacacattttggggggtatacattagacatatcagagcagtgtatttctggatcattttttaaatgacctcttctaaaacataactgtcacttacctgaaatgctgcatcctaaaattccaaaattatattgagcaatcgccaaggcctaaagccaactgacttaaaggtaatcatttcagctaagattaaatttaaagcctaagaatgtatagagctagttttaaaataatgatctcagatttttaaaaaggatataggaacctgcattgtcattctctgaattaagaactgatggtttctatcattatttagccccacctttgtattttaaaatccttcagaatacatttatgaaccanantgcgnacntggnacttagcncnnnancacanatggnaanattcagaccttgactnatnttggtgtttccannttcacaaaggtgatgaatgactgtcttgaggagcagcttaatccgcacactatttgtcacatttcttgctgctcctaggctgtgtgaaacttactgtgaaccatctaccatatacattgggtcctgtccaattctactgaatgggggtggacctggctattttatctggcca

SEQ ID NO: 281 - DNA, 450 bp, Homo sapiens
  modified_base (411)..(413): a, c, g, or t
  modified_base (417)..(418): a, c, g, or t
ttttttttttttttttttttttttttcttatcaaaaatattttatttacaaaaaattaattatactatacatcctatactggaaatacattgaataattgctaaaataaatacaggcaattaattcaactttttataagaatgagagaatttgacatttgaatgttatcaaagcttaacttagaacataaatagttaaaaaggcaaactcaagttttcatctcatttattggcatggtgtgttttgttttccacaagctctccaatcagtgagagtcttgagtctcagatgtacctttttgtactctgaaggtaggatgtgcagctttttcttaggcaggatagatgtaacatagatgactgcataaaaaagaggcagaaaggcaggaagcccattttttttttaacactnnnccanntgtctctgcctcaccataatgctgtttattca

SEQ ID NO: 282 - DNA, 483 bp, Homo sapiens
  modified_base (427)..(428): a, c, g, or t
tttttttttgccttcaactaaaaacaaaggagataaatctagtatacattgtctctaaattgtgggtctatttctagttattacccagagtttttatgtagcagggaaaatatatatctaaatttagaaatcatttgggttaatatggctcttcataattctaagactaatgctctctagaaacctaaccacctaccttacagtgagggctatacatggtagccagttgaatttatggaatctaccaactgtttagggccctgatttgctgggcagtttttctgtattttataagtatcttcatgtatccctgttactgatagggatacatgctcttagaaaattcactattggctgggagtggtggctcatgcctgtaatcccagcacttggagaggctgaggttgcgccactacactccagcctnngtagtccagcctggtgacagagcaagactccatcttcgtaagagaattatagatc

SEQ ID NO: 283 - DNA, 416 bp, Homo sapiens
  modified_base (379)..(379): a, c, g, or t
  modified_base (382)..(382): a, c, g, or t
  modified_base (389)..(389): a, c, g, or t
acatcaactaaagtagctaagctactgtaatgatttgaaagtttgttatgagagaattatgctttgtcaagccaactataaggcagctttctacaacagttctgcaaaatgtttccaccacattgagcaaagctgacactagacactagctacacgtgggaataggaagatgggccaggctcagagccgccgcaaaggatgaagtccactcagatttgaggcaatcctggggcaaagcactgagcaaagcaacttctctggtaatctcctcctcagccattctctacccaggatttcagaacacagaacagaagaaactgcaaaagccctgcaggatatatcacagctgttaacattctgactttaaaaaaaaaaaaanaangaccganttatcggtgaaacctggctcaaagacc

SEQ ID NO: 284 - DNA, 504 bp, Homo sapiens
tttttttttttttttggctgtgacctcttcaaaccgtggtacccccccttttctccccacgatgatatctatatatgtatctacaatacatatatctacacatacagaaagaagcagttctcacaatgttgctagttttttgcttctctttcccccaccctactccctccaattcccccttaaacttccaaagcttcgtcttgtgtttgctgcagagtgattcgggggctgacctagaccagtttgcatgattcttctcttgtgatttggttgcactttagacatttttgtgccattatatttgcattatgtatttataatttaaatgatatttaggtttttggctgagtactggaataaacagtgagcatatctggtatatgtcattatttattgttaaattacatttttaagctccatgtgcatataaaggttatgaaacatatcatggtaatgacagatgcaagttattttatttgcttatttttataattaaagatgcca

SEQ ID NO: 285 - DNA, 832 bp, Homo sapiens
  modified_base (266)..(266): a, c, g, or t
  modified_base (268)..(268): a, c, g, or t
tccacttgtaaaatcattttattggtataaatatacatatgaataaaatacttccagcctgtaatgtaagtgaatatttgtgaaatgtcttataaagagtagtattttgatttttacaggtgtcaaagtattctctcttaaaatcacacattaaaagctaatatgcagacagaaattaaaggccttcaaaaacatgaatattcataaaacctcattccaatcaactatatacattaatctgggcacatggtaaaatcagccatggncntctctcactctgttcttagctgtgctcgttgatggtatgcaaaggtcaccgaccaagctttaaatgtacaattccacatcaggaaggaagaagttccccatgggagaaggtaaaaaccatacccaagatctaatatatataatctatacaaattattagtgtgctctgttaatataattacaatgtgcaattgcatacatcaagaataaattgctatattgagtcctgtgcggatttgacacaggtacacttagcagtactccgaggtctgctgtggtgttacttgtgtgagtgtgtgtccagttatttcatttatctccaaaaactcatcttgcagggcaatctgtagctgcctcagataaattcaagtagggcccatgggataattgctggctttcattaaaggcatatgaaggaatgtttagaaatcaaatgcaaagggttggaggaagaccaaacaaatgtgctttgattaccaagaaatggatctgtttctatacaaaaaaaaaaaaaaaaaaaaaaaaagggggggggtttttgggttttcgggggcccccgccccaa

SEQ ID NO: 286 - DNA, 687 bp, Homo sapiens
agatgctagtactttaatccaggtatagcagtttcccgttattttcttgcttgtcgttcccctacatttcttcctgatttcccaagactctctttgtggcttttgagggtcagccaaggagcaggcaagtgagtgaacaatcctcaggaaaagaaggaccattttagcttaacacttcctttttttttttttttttttaagaagaatataggtaaacaggtaatgattcttgattggagataccatttgactcttgatgagagttgtacgaagatggaaatgagggatgattccaggcgttttagggggaaggctgcagataccattctaacccccaagatactgtgttctcaagacctcttagaactaggtgttgtcagggataatttgaggagggcttagtcttcagaacaatcctgcagtcttgacagaaatctaaaatctccaaaaactcctaccctttaaccttaccctagggggaactgatctatgaatattacatgtgtgattatgaaaggtgaagttgagtgagaggagttgaggaacgtggaagacagtgagctctcaccctaacactataagaagcatgatctcaatagaccaataattcacctttttatacatctgtaaataaatggaatgtttttaagaatataattatgtcagatttagcattttcttttatat

SEQ ID NO: 287 - DNA, 744 bp, Homo sapiens
  modified_base (442)..(442): a, c, g, or t
  modified_base (444)..(444): a, c, g, or t
  modified_base (448)..(448): a, c, g, or t
tatttttttcttgaatgtgcttcgcaagccaggctatcttccaaggaaggcagacagtgggagagcagagggactgactgcaggcaagcacattgaagaaagacactggcgggtttccccaccctcaccccaaagcagaaaactagcagacgtcagctcagccccgtcctgggcacagacactacacaaggagacgctggaagttaagcaatactttaatactgtaatatgtttgttttctttttctttcttttttttctaccaaaaaaaagtaagtaaactaaaacacaaaaacatataaataaaatccatccctcttgtcggggacctgcaggggggcaaccttaatccaaacacctggctatcaaataatcagaatgtattgtctcagacaggatttcagttccgggaggcaggggcatgatgggggagggggccggangntganagacaaaagttccagagcctccctcgaaggttctctactactgtattctgtacataatgtaccatcccatgtggaatctgtgagtgtcctcttaagtagcgtgggctagccaatctgccgttcatggtgtattgtaaactccgaattccatatgtaataggatgcaagtctaagcgtttcatgtggacataaatgtatctaaataaaactttccctagcactgtggctgacctcacccttacttttatactttagtatgaaactgatgagaacttggtagtgagtattttttttat

SEQ ID NO: 288 - DNA, 468 bp, Homo sapiens
  modified_base (6)..(7): a, c, g, or t
  modified_base (409)..(409): a, c, g, or t
ccccgnntttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccnaggacttacctgtcctaggggagtaggcaagcacttccactagggagggggtgggggaa

SEQ ID NO: 289 - DNA, 475 bp, Homo sapiens
  modified_base (156)..(157): a, c, g, or t
ttttttttttggttttaaagttctcttaggtataacttacataaacgttaataaatcttagggtacaccttggtgaattttgtatatgtctatacccaccacggtctccatcaaaatattttatcgtcccagaaatttcccttgggccccacctcnncctcaaaggttatcactattctgatgtctatcaccatagatttgtttttcctgttcatgtaaatggaaccataaacagccctcttgtgtctgttttcttcacttaatatagtgtcattgagatttatctatgttgtattatcagtagtttatgctttttaattgctgtgtaatagtccatagtctgaatataccacaatttaaaaattctattctgtttacaaacatttgagttctgtcctccaggttcatccatgttatcacaaatgacagaatttccttcctcatcaaggctgaatagtattccattgtgtagata

SEQ ID NO: 290 - DNA, 708 bp, Homo sapiens
  modified_base (495)..(495): a, c, g, or t
  modified_base (515)..(515): a, c, g, or t
  modified_base (593)..(593): a, c, g, or t
  modified_base (626)..(626): a, c, g, or t
  modified_base (628)..(628): a, c, g, or t
  modified_base (631)..(631): a, c, g, or t
  modified_base (638)..(639): a, c, g, or t
  modified_base (662)..(662): a, c, g, or t
  modified_base (672)..(678): a, c, g, or t
  modified_base (680)..(681): a, c, g, or t
  modified_base (684)..(684): a, c, g, or t
tttttttttttttttgtaaatttgagacttatgtaagcgtgatttcaaaccataattcgtgttgtaaatcagactccagcaatttttgttgtatgattttgtttttttgtaaagtgtaattgtccttgtacaaaatgctcatatttaattatgaactgctttaaatcactatcaaagttacaagaaatgtttggcttattgtgtgatgcaacagatatatagccctttcaagtcatgttgtgtttggacttggggttggaacagggagagcagcagccatgtcagctacacgctcaaatgtgcagatgattatggaaaataacctcaaaatcttacaaagctgaacatccaaggagttattgaaaactatcttaaatgttcttggtaggggagttggcattgttgataaagccagtcccttcatttaactgtctttcaggatgttccttcgttgtttccatgagtattgcaggtaataatacagtgtattcatanagaatctcaatcttggggcnaaatgccttgtttctttgcacctcttttcaagtccttacatttaattactaattgataagcagcagcttcctacatanagtaggaaactgccacatttttgctatcatgantngcntgggccnnctgctgttcctagtaagatattntgaattccannnnnnnannaangcttgagttaacaaacaagaaact

SEQ ID NO: 291 - DNA, 873 bp, Homo sapiens
  modified_base (28)..(28): a, c, g, or t
  modified_base (56)..(56): a, c, g, or t
  modified_base (63)..(63): a, c, g, or t
  modified_base (137)..(137): a, c, g, or t
  modified_base (139)..(139): a, c, g, or t
  modified_base (143)..(178): a, c, g, or t
  modified_base (186)..(186): a, c, g, or t
  modified_base (188)..(188): a, c, g, or t
  modified_base (192)..(192): a, c, g, or t
  modified_base (194)..(196): a, c, g, or t
  modified_base (649)..(649): a, c, g, or t
  modified_base (680)..(680): a, c, g, or t
  modified_base (685)..(689): a, c, g, or t
  modified_base (691)..(694): a, c, g, or t
  modified_base (696)..(696): a, c, g, or t
  modified_base (747)..(747): a, c, g, or t
  modified_base (750)..(762): a, c, g, or t
  modified_base (764)..(764): a, c, g, or t
  modified_base (766)..(766): a, c, g, or t
  modified_base (768)..(768): a, c, g, or t
  modified_base (770)..(770): a, c, g, or t
  modified_base (772)..(772): a, c, g, or t
  modified_base (774)..(775): a, c, g, or t
  modified_base (779)..(780): a, c, g, or t
  modified_base (784)..(784): a, c, g, or t
  modified_base (788)..(788): a, c, g, or t
  modified_base (791)..(794): a, c, g, or t
ggccagggtgcaaggagaaaggattttnaggaggggactccatggcttccgagttnctgactnaccctccacctcagaggtagttctgacactgtctcagttttgcagatgaagatgagattcttcagttctccatntngaannnnnnnnnnnnnnnnnnnnnnnnnnnnnnnnnnnnaagcagcngnggancnnngccgaccgctgtaaggaggtacagcagatccgcgaccagcaccccagcaaaatcccggtgatcatcgagcgctacaagggtgagaagcagctgcccgtcctggacaagaccaagtttttggtcccggaccatgtcaacatgagcgagttggtcaagatcatccggcgccgcctgcagctgaaccccacgcaggccttcttcctgctggtgaaccagcacagcatggtgagtgtgtccacgcccatcgcggacatctacgagcaggagaaagacgaggacggcttcctctatatggtctacgcctcccaggaaaccttcggcttctgagccagcagtaggggggctcggcctgggagtcggggggccccggtcaggccctgcccagagagctcctggttcctgaactgagctgcctctaccgtggtgggctgggcaggcatgtgcccccctagncagagggcaccaacccacctactctgccccngggtnnnnncnnnncnggtcgtgttagggttgtccctctgggtgctggctggtgggatgggggaggntgnnnnnnnnnnnnnancncncntncnntgtnnttcntctnttnnnnaggcaagtaatactttcattatgtgtctgtttttattaattatgtcaattgatgtcttttcattgtcatatatcgcact

SEQ ID NO: 292 - DNA, 1370 bp, Homo sapiens
  modified_base (7)..(7): a, c, g, or t
  modified_base (12)..(12): a, c, g, or t
  modified_base (65)..(65): a, c, g, or t
  modified_base (153)..(154): a, c, g, or t
  modified_base (156)..(159): a, c, g, or t
  modified_base (161)..(161): a, c, g, or t
  modified_base (189)..(189): a, c, g, or t
  modified_base (366)..(366): a, c, g, or t
  modified_base (752)..(752): a, c, g, or t
  modified_base (770)..(770): a, c, g, or t
  modified_base (774)..(777): a, c, g, or t
  modified_base (784)..(784): a, c, g, or t
caatggnagccntaggactgacagcatcagaagaatttatcaagatcacattgtcagcttttgangcaataatacagtatcctattttattgaaagactatcgctccacggttgttgactatatactgccacccttggtgtccttggttcaanncnnnnangtggagtggagactctttagcttgcggntgctctcagaaaccacatctctactcgtgaaccaggagtttggggatggcaaggagaaggccagtgttgattctgacagcaatcttctggctctcattcgagatgtcttacttccccagtatgagcacattcttttagaacctgacccagtaccagcatatgctctgaaactgctantcgcgatgactgaacacaacccaactttcacaagacttgtggaagaaagcaaactgatcccactcatttttgaagtaactctggaacatcaggagagcattctgggtaataccatgcaaagtgtgattgcattactcagcaatctagttgcctgcaaagattcgaatatggaactactttatgaacaaggacttgtcagtcacatctgtaacctgctcactgaaactgccacactgtgcttggatgtggacaataaaaacaacaatgagatggcagctccactgctcttttccctgcttgatattttgcacagcatgctgacctatacctccggtattgtacggctggctttgcaggcccagaagtctggctcaggagaggacccncaggctgcagaagacctnctgnnnntcaacanacctctgacagacctgattagcctgctcattccactgcttcctaatgaagatcctgagatttttgatgtttcatccaagtgcctgtctatactggttcagctgtatggaggggaaaacccggacagcctctctcctgaaaatgtggaaatttttgctcatttactgacatccaaggaggacccaaaggagcagaagcttctgttaaggattctcagaagaatgatcacctccaatgagaagcacttggagagcctcaagaatgcaggcagcctcctgcgggctctggagcggctggcccctgggagtggttcatttgccgacagtgcggtggctcccttggccctggaaatcctccaagccgttgggcactaggcaagaaggtgcttagcacaagcccgccctgtggccccagccctcggatgcataagcaaggtcagctcccagacacctttgccacatcccctcacagctgtctttggacctaataaagtcagcttaacccagaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 293 - DNA, 1921 bp, Homo sapiens
  modified_base (58)..(63): a, c, g, or t
  modified_base (65)..(65): a, c, g, or t
  modified_base (69)..(69): a, c, g, or t
  modified_base (73)..(73): a, c, g, or t
  modified_base (77)..(77): a, c, g, or t
  modified_base (95)..(101): a, c, g, or t
  modified_base (104)..(104): a, c, g, or t
  modified_base (106)..(107): a, c, g, or t
  modified_base (114)..(114): a, c, g, or t
  modified_base (119)..(119): a, c, g, or t
  modified_base (123)..(123): a, c, g, or t
  modified_base (129)..(131): a, c, g, or t
  modified_base (145)..(145): a, c, g, or t
  modified_base (156)..(156): a, c, g, or t
  modified_base (166)..(166): a, c, g, or t
  modified_base (208)..(208): a, c, g, or t
  modified_base (247)..(247): a, c, g, or t
  modified_base (295)..(298): a, c, g, or t
  modified_base (300)..(300): a, c, g, or t
  modified_base (470)..(470): a, c, g, or t
  modified_base (521)..(522): a, c, g, or t
  modified_base (535)..(535): a, c, g, or t
  modified_base (537)..(537): a, c, g, or t
  modified_base (681)..(681): a, c, g, or t
  modified_base (785)..(785): a, c, g, or t
  modified_base (792)..(792): a, c, g, or t
  modified_base (871)..(871): a, c, g, or t
  modified_base (893)..(893): a, c, g, or t
  modified_base (942)..(945): a, c, g, or t
  modified_base (948)..(948): a, c, g, or t
  modified_base (950)..(952): a, c, g, or t
  modified_base (955)..(959): a, c, g, or t
  modified_base (961)..(970): a, c, g, or t
  modified_base (972)..(977): a, c, g, or t
  modified_base (1280)..(1280): a, c, g, or t
  modified_base (1364)..(1364): a, c, g, or t
  modified_base (1373)..(1373): a, c, g, or t
  modified_base (1377)..(1378): a, c, g, or t
  modified_base (1380)..(1382): a, c, g, or t
  modified_base (1384)..(1386): a, c, g, or t
  modified_base (1388)..(1389): a, c, g, or t
  modified_base (1571)..(1574): a, c, g, or t
  modified_base (1582)..(1582): a, c, g, or t
  modified_base (1584)..(1584): a, c, g, or t
  modified_base (1591)..(1591): a, c, g, or t
  modified_base (1667)..(1669): a, c, g, or t
  modified_base (1671)..(1672): a, c, g, or t
  modified_base (1674)..(1674): a, c, g, or t
  modified_base (1676)..(1685): a, c, g, or t
  modified_base (1687)..(1687): a, c, g, or t
  modified_base (1689)..(1689): a, c, g, or t
  modified_base (1691)..(1691): a, c, g, or t
  modified_base (1693)..(1693): a, c, g, or t
  modified_base (1699)..(1700): a, c, g, or t
  modified_base (1702)..(1703): a, c, g, or t
  modified_base (1705)..(1708): a, c, g, or t
  modified_base (1752)..(1752): a, c, g, or t
  modified_base (1762)..(1762): a, c, g, or t
ccccccaaacttttttttttcttttttttctttttttttgttttttttttcttttttnnnnnncntttntttntttntttttttttttttttttnnnnnnnaanannttgtaancaaancttnaatccnnnggattctcacaaancatattacaantgacagcatnaaaaaaaaatcttgcacagtaactcaaagttcggctctacantgtacccttaaactggcaggacatttttgaaatcacaantttgcacataaagaatgtcacgaacagccatgtatccatatacagcannnnanataaggaacttatgacctaaagcaaaggtaaactttcttgaaacttaacattctataccaactaggcaacctctgcccaggatgagagttggatttttcaaaaacctctaatttaatagtgcagcatttcgttttccctgatggcctgtgtttcacagcagtttttaaanactgcttgttcaactatagctgcagcctatatcccagctatggaaaaaaanngtaaatcttagtncnaatttttgccagttgtttctgtatttaaatttaaaaaaaaacacacttccgctgggcaggtttagaggtttattatcagtctgtgcataactaaaagttcaaagcaaattcaattttgcttaagggaacattgtaaagtaacanttcttggtattacatgcctcgtatgatccatttcaaaccatagagaattacacctttgtgtcactgtttcaagagacaaacagatttgaacagctaaaacatcntaaaaantgcaccaagcttatgaagtctcaaacaaaacttgaattttctgtacatactcctgtcaaatgaagtaatttcctgtacnccacttctcttgcaaactgtcntctatttcctttcatttgacctagatcgactaaaaaaaaaaaaaaaaannnnaanannnaannnnntnnnnnnnnnntnnnnnnggtgacactttagtgacatatcgaaatagaactttaaggtaaaaaatttatggcttagaagacaggccttagcatactatgtatgcaaagtcttaaatacaagttatcaaagatcttacctacgagacctagagaaggatcgggacggcttgtgatttctctcccgagacagcgatctctctcttctcctatctctagaaagggacctaaacaagcaaaaaaacattaggaccaatgaggtatgataaaattatacataaatattttcttgatctggcatggtgactcatgccaataattccnatattttgggaggcagaggcaggaggctcacttgaagccaagagtttgagaacagattggacaacaaagtgagatcccatctcnacaaaaaanaaannannnannnanngcagtacttgcctgtagtccaagctactcaggaggctgaagagggaggatcactccaaggccaggagttaaaggctacagtgagctataatcacaccactgcactccagcctgggtgacagatcctttttttaaaaaattaaatactttctaaaaagcctttgaaaactcaaagaaagctgnnnnatccttanancttgatncactattaaagccaaggtttattcccattaactaagccacctggaaaagtttaggaatagcagaaacactgccatnnntnncntnnnnnnnnnnancncnanaaaggnngnnannnncctgctccggctgcgagagaagcttctccttcttggagatctanaagcagaaanaggaaaattaggctcatcatcaattagtatttatggcgtgaggcatttcccaacttttcaatctcactgttgggcccagtgaatgtgccgaagaactggcacccatcgtccaaaaaaaaaaaaaaaaaaaaaaaagaaaaaaaaaaaagaaaaaaaagg

SEQ ID NO: 294 - DNA, 833 bp, Homo sapiens
  modified_base (61)..(62): a, c, g, or t
  modified_base (64)..(64): a, c, g, or t
  modified_base (66)..(68): a, c, g, or t
  modified_base (70)..(70): a, c, g, or t
  modified_base (72)..(75): a, c, g, or t
  modified_base (77)..(81): a, c, g, or t
  modified_base (83)..(83): a, c, g, or t
  modified_base (85)..(87): a, c, g, or t
  modified_base (89)..(90): a, c, g, or t
  modified_base (92)..(96): a, c, g, or t
  modified_base (98)..(98): a, c, g, or t
  modified_base (102)..(104): a, c, g, or t
  modified_base (251)..(251): a, c, g, or t
  modified_base (314)..(314): a, c, g, or t
  modified_base (325)..(326): a, c, g, or t
  modified_base (343)..(343): a, c, g, or t
  modified_base (348)..(348): a, c, g, or t
  modified_base (350)..(350): a, c, g, or t
  modified_base (354)..(354): a, c, g, or t
  modified_base (362)..(362): a, c, g, or t
  modified_base (368)..(368): a, c, g, or t
  modified_base (387)..(387): a, c, g, or t
  modified_base (401)..(401): a, c, g, or t
  modified_base (404)..(404): a, c, g, or t
  modified_base (486)..(486): a, c, g, or t
  modified_base (636)..(636): a, c, g, or t
  modified_base (697)..(697): a, c, g, or t
tttaaatgctggaaaaagtagatatttaatgaaaaatggattaggtactataaaaaaattnnantnnntntnnnntnnnnncntnnntnnannnnnanattnnnttcttctgtttcattaaacactcccaagtcttcaagttctctcattcgctgtctacgcatcttcttcatgtcatccattttttgaagtacagcttcagcagtgttagttataagtttgtcaaacagcatggactggtttacaccacntataacgacttctaatcctacaacttcgacgcacttcaacatcaccattatcttcatgtaagntgttctgtacnnttgaacgatgtttctangcccncnatgnaccgagtnactggnatcactttgtcttctctgngctcttcttttttnttnatcagcctgctgtctggccaactgccttgtaaaatgcctgccattagcaagttgctccgttatttccacattcttctcaaanctagaatctgaagaattctgtgcatcttttctcaaagatcttaaagcacgtgtccggtggtaggtttcaacttccttaactgatgacccatcgcccgctttggctgtggtcgccgcgggtttcttctgcgccgcgccggccgagcggagncgcctccggccgatgtgctccagactgaggaagtcactggacaggtccaaggagcccgtgnccgaggccgcggagtggttgtgcagctccaagctgctgcggagaaccaccatcttctctccctactggcctcggcgtgcgcgaccggagagagatccagctccaggcgctcgcagctctggctcttccgcgctccc

SEQ ID NO: 295 - DNA, 1424 bp, Homo sapiens
  modified_base (472)..(472): a, c, g, or t
  modified_base (479)..(486): a, c, g, or t
  modified_base (489)..(496): a, c, g, or t
  modified_base (500)..(505): a, c, g, or t
  modified_base (767)..(767): a, c, g, or t
  modified_base (998)..(998): a, c, g, or t
  modified_base (1006)..(1006): a, c, g, or t
  modified_base (1261)..(1261): a, c, g, or t
  modified_base (1389)..(1389): a, c, g, or t
  modified_base (1391)..(1392): a, c, g, or t
  modified_base (1395)..(1396): a, c, g, or t
  modified_base (1413)..(1414): a, c, g, or t
  modified_base (1421)..(1422): a, c, g, or t
taataatcaataatttcttattttaaaaagtagtactatttaatataatcaagataggagatttaaaatgagcaagtgattcatttgctcttttaaagaagcccgttgacttacgcttttaaaaaagaagttggtgggttacctcaattattgttcatgcttaaacatatccatttgtacaggcttatttctacgtgggacccaatcatatatactatatttctcaaataatttttctaaaactctggcctatattctaaacacttgaccaacaccttagttattgaataggtaaccatttttaaagtacatgtggttcattttttaaaattcaatctctcaagaccgttagatatttaataatttaagctgataagggtatcaaaatgcacattaactttgatcatcatgatttaagttgtaactttgtgttattatataaatattaggttgtttataaatatattgcagnaaagtannnnnnnnaannnnnnnnaaannnnnngactgtggtttagagttatatatttttgcttatttttaaacttcaattattccattcttctgccttataataaaacttttaaggcagagaactgaactaattatagaatttctcctttggagagttataatgttacatagtgaacattcttataaaagaaagaataagtttaagttgatgaatatttagctgcaaagattttttacttaaaaaaatccatgaatatctttgattttattataaagcatttgtaaattatttncatttgagctgtaagattcataaacatttacatttcccaatgatttctattttgatttttaaaaaatatacagggcaagctacatttttaaagcattaatcaacaactttattatattacacattccagtgcacaaacacacaatatcatttaatactcacagtagtacctgtgaaatatatcagatggatattcctatctctattttacagcagaggaaaccgaaattcngagaactnacatttctaaggttgtacagctgcaaaatgaccaaattgtgaagtccctaacatccaggttttcataatgccagtactctttctatgacatgtttatgaccctccaaatgtaccaaaactacctaactaattcactgagaggaagccaactgcaaaaataggatttttaaaagtacaatagagtattactacattttatggatttcagacaaagaaacctccgtttattatatcctgatggtgagtattgccagntctaaattattcatatttctaagaccaaggaaaatataggtaaatgaaaattttgaaataaagaacaatgccttaatttgtaaaatctatcattgctaccaccctgcccaggtctggccatttgccananntgnnggtaaataaatacaatnnctgatannaa

SEQ ID NO: 296 - DNA, 714 bp, Homo sapiens
  modified_base (2)..(2): a, c, g, or t
  modified_base (362)..(362): a, c, g, or t
  modified_base (455)..(455): a, c, g, or t
  modified_base (629)..(629): a, c, g, or t
tnacgcacacaaatgtatatttattagcaagaaaaggcgttcacaatatattgataaaagggaaaagttgaagtttcctgccagtttgtgagaggcagctgttgcttagtgatcaataattaagaacacacaggctgtgtggaggcagacacatggatccactaattcactgtgaccttgggttaattgttctaagcctcagtttagtcatctctaaaatggggataaaatagcatccctcatagctgtggttaagtgagattatttgcacattcaattgacaatatttattgaacatctctgtggcagggaaacaaatggttcctgccctctgagagcttccagtctagcaaaaaaaaaantcagaaatcccacacccgtattaaacataaaaataaattacagatgatggtacaagtgatcaaggaaaggtaatggatgtgatgaaactaacnaagggccctgacttgtgctgtcaagaagcctctgaagaagtgacatttaagatgaaacctaaaattatgagagaactgcagctgttacagccaaaggggaaatgatgacatggacaaaggcctcgaggcaggaggagctgctggcagccagctctcggcataagctttggcatncagtaagtgccttgcatactgctgtattgcaattgaaaaaataaggatctggccaggcggacatctgtcaaaccttcctagcaac

SEQ ID NO: 297 - DNA, 498 bp, Homo sapiens
tattttatgtgtggtccaagacaattcttcttccattgtggaccagggaagccaaaagattggacacccctgtctagggcaaggattccaaaagtatgttctgtataaaacttgcatagagattccaggaacacttgttcaaatgcaaattcctggtccagatctcaaagatcagtctctgcacgtttggacatttttaacaagcaaccctcatgatttttatgatccttaagtttgacaattctagggccttggtcttcaaaatgacacatgcatacccttgagaacacaccaacattttcccatgggggtaaggatacatgcatagctctatggaaaccaacttaaagatgtccaatttccatatgtgttgtcctaaaatatgtgctctgatgaggcctcttcagatctaccatttctctttacctcccttttcacaacagccatactccctatcctccaaaaaaaaaaaaaaaaaaaacgggcggcctctcaacc

SEQ ID NO: 298 - DNA, 719 bp, Homo sapiens
  modified_base (28)..(28): a, c, g, or t
  modified_base (32)..(32): a, c, g, or t
  modified_base (49)..(49): a, c, g, or t
  modified_base (74)..(74): a, c, g, or t
  modified_base (77)..(77): a, c, g, or t
  modified_base (148)..(148): a, c, g, or t
  modified_base (167)..(167): a, c, g, or t
  modified_base (184)..(184): a, c, g, or t
  modified_base (186)..(186): a, c, g, or t
  modified_base (693)..(693): a, c, g, or t
  modified_base (697)..(697): a, c, g, or t
  modified_base (699)..(699): a, c, g, or t
  modified_base (706)..(710): a, c, g, or t
gatcctcctgcctcatcctcccaaaatnctgngattacaggcataagcnaccgtgcctggcctctttaataatnttnaaaataccctaaaggcttgtgaatatacaagtctactgataaattatgtattgtctgggaatttgatagtnattgttttagataactggnttttacgctgtggtagncnggctgtgacactagtgttgcacaggtgtaattggtcatcctatgccttcaccagaataacttgggagtggtgccagaaactagagtctacaattctcactgtttagagagtgttaatgacatactgtgtatgcataatagccgcatgtactataatagcccttaaaattaaactattgggattgctgtaaatattttaaagtactggaggtgccttttacctgtttattagattttgaaaaggtttaaattatttcatgagcaatcttttaaatttcatttaacataaagctgaaaattcaataacaggataaaaaagctttttaacaaggctgccatttaacttaaatgtgttcatcttagctttcacttgtataaaatttgattctttgaactgcagcaataaaaccctcagctcctaagaagtcttaagagggtattctatatattctgctttgttttattttctgtaaattttgtaggtaaatatgtgcattaaaaataaatncttnanatataannnnnaaaaaaaaa

SEQ ID NO: 299 - DNA, 469 bp, Homo sapiens
  modified_base (394)..(394): a, c, g, or t
  modified_base (426)..(426): a, c, g, or t
tttttttatattccagtaaaactttatttagataaataaggagctagacagattttgcccatggaccatagtttgatcatggccaacctatgatctaaaccaaagtccctaggcaagttgcaatagaaaagttgtgtgagacagtgagattttgcctttgttattcaatggcaagctagcccatgctgacacagaaattggtcccttgttttttaaaatgctaaaatactgaacactggcttaatggttagctggcaggcattcaggaaattgctatcagaagatggaagaaataacttacacaagggtaatttatattatggaaaggtgaaactgccccttgagataacctgaaaggcagatcatctaccctttactaaagaaaaagacaganaaacaaaatattttgtagttgctgttcactgnacttgacaaaacgtacagaagagatgaactcagaaaagactgg

SEQ ID NO: 300 - DNA, 539 bp, Homo sapiens
ctttttttttttttttagaggctgtaaagacttttctttattgttcatttattctgttcccttatataagctaggtattaggctaggtatggaaatacaaaaaggaataagataaggcagctgccttcaaggatctcactgtctagggaaggggaaacacaaatatctcaacaccattgagtgagtgtgatgatagagatacgcattcagtcaacaaacatgtcctatgtgctgggtgctgtgctaggtgctgaagatacaatgaacgaagcaagcatggtccttgaattcaccgagctcctattcctgtgcccgcggctcggctcctcctcgctcgcgctgccccagccggggctgaggtaccgggccgggtccccggcgccccgagtctccgccccctcctcctcgtcctccaactcgtccacgtcctcggcctcctggatggcgacgcggatctgcaccgccgtcttgggcccgggccgagcctccccgccggactgggccatggctcgcgggactgcggcgccgccggggtcctc

SEQ ID NO: 301 - DNA, 508 bp, Homo sapiens
  modified_base (72)..(72): a, c, g, or t
  modified_base (413)..(413): a, c, g, or t
ttttttttaaatccaaattctattatttattgagtagtagccacaatcaagtcattgggtttctatgaaccncagtccatctcatataaagtgataatgatgatagctaacatgtactagcacttaatatacaccgggtaccattctaagggcctcaaatggataacataatttattcttcacaaaaatgttctgaaatgagaagtatgagtgtccctactttacagaagaggaaactgaggcatagagaggttagggaacttgggaatggtggagccaagaattgaactcaggcagtctgcctctggggatcttagcccatgtgtggtaacaatacttacctcaactatatcatagagtttctaggagttgcattagaaaatgagtataaaagcatcttttaaaccataatntattagtcttggaaatactgagcaagatgctgaatctcaagttgtaagctttttttttcttttctttttttatttagagacagggtctccctctg

SEQ ID NO: 302 - DNA, 387 bp, Homo sapiens
  modified_base (385)..(385): a, c, g, or t
ttttttcagatatcagccttaggatcagctttattatgtattttaccttcaccagggagaagaaggcaaggaagctggagaacagaccagcctgcatcacacagacacaaatcacatctctaaagagtgtacatggtgagaactaagggcccacattagaccagctatgaagcacagagattgacaagggcaccaaacatccatcttatctttcccttctggttgtttggattcaatcgtttacatactttcggttcattttaaaaaagcacaaccaacatttcaaagttcaataatttgctgttctttttagtgtacagagacaaaatcaccaaatttttgatttttgaaacaccgcaagccgctttgtctcaacacctgtggngg

SEQ ID NO: 303 - DNA, 820 bp, Homo sapiens
  modified_base (3)..(3): a, c, g, or t
  modified_base (21)..(21): a, c, g, or t
  modified_base (28)..(28): a, c, g, or t
  modified_base (30)..(30): a, c, g, or t
  modified_base (36)..(36): a, c, g, or t
  modified_base (38)..(38): a, c, g, or t
  modified_base (45)..(45): a, c, g, or t
  modified_base (48)..(48): a, c, g, or t
  modified_base (86)..(86): a, c, g, or t
  modified_base (141)..(141): a, c, g, or t
  modified_base (148)..(150): a, c, g, or t
  modified_base (152)..(152): a, c, g, or t
  modified_base (154)..(155): a, c, g, or t
  modified_base (161)..(161): a, c, g, or t
  modified_base (166)..(168): a, c, g, or t
  modified_base (170)..(170): a, c, g, or t
  modified_base (305)..(318): a, c, g, or t
  modified_base (320)..(322): a, c, g, or t
  modified_base (324)..(328): a, c, g, or t
  modified_base (330)..(331): a, c, g, or t
  modified_base (625)..(626): a, c, g, or t
  modified_base (629)..(629): a, c, g, or t
  modified_base (641)..(641): a, c, g, or t
  modified_base (647)..(647): a, c, g, or t
  modified_base (697)..(697): a, c, g, or t
  modified_base (713)..(713): a, c, g, or t
aantctttactcagtagaagncagctancnggtgcnanaataaanaanagatacctaacccaataaaggcaaaatcttagttatantaaccagcaaggtacatattacattattattactagaccatgcctccaagtgtgncaaattnnnananngtgttnagcannnanaaaatatacattaaagatttctctcatcataggcacaatctaatacaaaaatatatttgacatttataagttagaagatccattgagagcctccaaaataggacaggggaaggaatgagtgatgacaacataaannnnnnnnnnnnnntnnntnnnnntnnttccacttatatgattattttcttcatcagcaaagggttaagagcagtttacaccaaaccaagttaccaagcagatcacaatcagttcacaggttggataagtcacggcacgcaggccagaaaatgtactcagacttcagtcaacctaatgggacagtgtactcacactgtggttttgttgttttggagtctagaagctccatctacccattctccatggtctaccaccatgttaacacagatttaccacaggcgccatctgtaccaagcctaggatagactctttaaaaaaannaangacctggccggncacagnggttcatgcctgtaagcattttgagaggacaaggtgggtggatcatgagntcaggagttcaagacnagcctggccaaggtggtggaaccctgcctctactaaaactgcagaaagtagccaggcacgtcggtaggaacttgtaatcccagctactggcgaggtcgaccgcccgc

SEQ ID NO: 304 - DNA, 562 bp, Homo sapiens
  modified_base (15)..(15): a, c, g, or t
  modified_base (285)..(285): a, c, g, or t
ttttatctttaaccnatctcgtttattttttgtatatacatctacatacattttatacattatattcatatatacatatatacaaatgtatatatgtttaaagccacgctataagaggaagtaaatgagaaacagacaaatgaagtggtagctggaggacgtgggaatcagtacaggttttcacgcctgtttcagaaatgggagattctacagcacgctcgacactaacacatcacatccataacatatcacatccaatagacaggacagccaaaaacacaaaanaaaaaaagaatcaaatacccacacccagacacaatactcaacaacacaaatacccgaccaaagtctttaagaaagcaaaagaggctgggcacagtggctcacacctgtaatcccagcactctaggaggccaaggtgggtggaccacttgaggtcaggagttcgagaccagcctggccacatggcaaacctcgtctctactgaaaatataaaaattagccaggcatggtggcacacgcctgtaatcccagcagtttgggaggctgaggcaggaggctc

SEQ ID NO: 305 - DNA, 428 bp, Homo sapiens
  modified_base (157)..(157): a, c, g, or t
  modified_base (191)..(191): a, c, g, or t
  modified_base (237)..(237): a, c, g, or t
  modified_base (249)..(249): a, c, g, or t
  modified_base (258)..(258): a, c, g, or t
  modified_base (262)..(262): a, c, g, or t
  modified_base (271)..(271): a, c, g, or t
  modified_base (276)..(276): a, c, g, or t
  modified_base (288)..(288): a, c, g, or t
  modified_base (302)..(302): a, c, g, or t
  modified_base (304)..(304): a, c, g, or t
  modified_base (381)..(381): a, c, g, or t
  modified_base (386)..(386): a, c, g, or t
  modified_base (395)..(395): a, c, g, or t
ttttggaaaagaaatattcctaataattcatttaatcatctggagagtgggttgaagttttgtaaaatttaatttcttcattatagactgtattattttaataaaagcttttctttggtgtcacccattgtgtgcagcactgagctggggccctggnagctctcactattgtccatctggccgcaccactntcagcactgctttcaatgaactgtaacagaatactgatgactcagncatttctgctgnctgacaggnaagntccttgagncgagntctctttgtagnttcctccaagaaangnatgctcaggcactccttgggtgaacagctgcaggccatggagaggacaaccgggttgcaagtagtaagtttgcactngggcnatcccagangctagaacaaggggaacaggtcagcccctagag

SEQ ID NO: 306 - DNA, 418 bp, Homo sapiens
  modified_base (108)..(108): a, c, g, or t
  modified_base (245)..(245): a, c, g, or t
tttcttttcttttttttttttttttttgttttttgccagaagtatgatccagttgtcagtaataagatatacagggagacaggctaggcatcctctaggaatactttngctttctagataaacaacaataggaacacaacagtatcttttcttcttcctgactcaaatgcaatggacacaatgacttcaagccttgacagccattcagtaaccgtgagaaccacttgctgcttagaatggcagancagaaacacacagagcctggcccttgctggaaccactgtgcaaacgaaccatgtcgtgcaaggaaaaacaaaccccaatctgtttaaggccttgttggtcaagttttctatttacttgcaggtgaaaatgttcctatcagaaaaaggaattattatggataggatgaccaagt

SEQ ID NO: 307 - DNA, 637 bp, Homo sapiens
  modified_base (9)..(9): a, c, g, or t
  modified_base (11)..(11): a, c, g, or t
  modified_base (13)..(13): a, c, g, or t
  modified_base (68)..(69): a, c, g, or t
  modified_base (77)..(77): a, c, g, or t
  modified_base (155)..(155): a, c, g, or t
ttttgtttntnanaaatttttatttatttaaagaaataacattggttattgattagatatatatcatnntggtttanggtatgagatatagtgtccaatgtggtattattagtttaatatatatctacttgtggcaatagtgaacagtttcaagngatgaatacataatttaaagggggagaacgacataactgcacgttcatttcaatgtctgagtttgataaccaaaagtactttcattttttagataaaaattttctatttcccaaatctcaagacctggatacaaaatgtagagctgcagatttaaggcctgaatggctggagtagcaggtgttacctgaacatttgtgaacattttaccaagagaaaaaaggggaaagtggagattctcatgtctacatgtgtactcaatgaacacatgttactctgattaggtttgtgggccccatggtctccgaatcagtttcaggtctgaagataacaagagtcattgagggaaataaaacgattgattgttgcccagtgaagttggtagaaattaggatgaactatgtatgacatggtgctgtaaattcttctacttgtggactaattttggtgaccatctgtctaatcatcttaaatccttgagttt

SEQ ID NO: 308 - DNA, 534 bp, Homo sapiens
tttttttttttttttttttttttaggaatgaaaggtcataagccattagaaatagtggcattattatgcaataacaacaccctagctaacctgcttttgtcatctgtagcacttacaataaagaatgatgaccttccaaccctggacactacctcgataaagcaaaccagagatcctctctacactttctatggaagccataaaagttgccatcaatatatccactttcatagttctatacttttatactttctagacttttttatagactttatgatcagatctttttgtctcagaggataggttttgcaagattcaaaggaaaatcaaactccttggttgttccagctttgaagcttttgcttcagtaaatttgtttaaagaaccagatcacataccatttatcaaattctttacttaagtcagaatactttgcagacatacatatttggaaaacaaactgtttcttgttcactagatagaatctgtattgtagtaagaaactacttacaaggtggctttctttctgctttg

SEQ ID NO: 309 - DNA, 499 bp, Homo sapiens
  modified_base (89)..(90): a, c, g, or t
  modified_base (358)..(397): a, c, g, or t
aaaccccttctccggtgtgtgcaatgggttgaagcttgtttcctggagccagaagaggggttttcttcttttctttcctttcttttttnntttttttttttttttttaaatttttggtcgtgcacctggcttgtccccgagcgtaatattcttcaatggaaacggatctaataggtgtgagtgtgtgtgtgtcctatgctcgcgtgtgtgatgggaggtataaataaatgagtgccggtgcggcggtgtctatggccgcgctctgtgtctccgagcccctaacactaatgtcgggatcaaagggcagcggcggcggcagcacagctcacagctcgctctcttgctctctctctctctnnnnnnnnnnnnnnnnnnnnnnnnnnnnnnnnnnnnnnnnctctctctgtcacacacacacacacacaagaggcacagactgagggaaagagcgagagctacacacacacacacgcacgcacacacacacacagagcaaaga

SEQ ID NO: 310 - DNA, 645 bp, Homo sapiens
  modified_base (4)..(4): a, c, g, or t
  modified_base (234)..(234): a, c, g, or t
  modified_base (249)..(249): a, c, g, or t
  modified_base (315)..(315): a, c, g, or t
tttntttttattgtcactggatgtttattaagtattttagtttcataacttattttcataaaccttttgttcactatttgtttgggtaaatctcatcaaatttaaacacccgagactcttaaatgttctggagttttgtgggaaagtaaacacctatttgtaagtattgatatgtaaaaagttcaaattttagtatatgaccaactacaatttgcatttctctaccaagtaacnctctataatggaatntcactgtaaaacagacacttatgtccagcacaaataaagttcacaataattgtttatcacaagtanacaatcagcaaacttaatgttttacttataataaatacatgccatatacttagattctagaaagtcatcactcactacttctttgtggtaggtagcttcacagagactgtgaaacagatcatggaaagaaactgattttaccatgtgcgaagttaaagtgaaccacgtatcactcagcgcacggtggctcacgcctgtaaacactgctttagctgcatcttgtaagttttggtttgttgtgtcttcattatcacttcatctcaaggggtttgtaatttcccttaagaattttttctttgacacattttttttttttggtgttaatgacag

SEQ ID NO: 311 - DNA, 507 bp, Homo sapiens
  modified_base (13)..(13): a, c, g, or t
  modified_base (421)..(421): a, c, g, or t
  modified_base (423)..(428): a, c, g, or t
  modified_base (430)..(431): a, c, g, or t
  modified_base (449)..(449): a, c, g, or t
  modified_base (451)..(461): a, c, g, or t
  modified_base (464)..(465): a, c, g, or t
  modified_base (468)..(468): a, c, g, or t
  modified_base (491)..(491): a, c, g, or t
ttttttttttttngaggttttaggcacatatttattttattttttttaatataaaagtaaaagagtacattgttgagtagaggattaaaggagtgacgaccctttctaaagtggggtctcccatcccggatccctaagactgtaacatctgctacatacattaaaaacaaaacaaaacaaaagcaaacatgaaacttatgacctgacttcactccacccttcatgcctgcattatgacagaaacacgtcccactgctcctacttatgtatgtacatccagagctccaaacctaagctgtggccccctcctcccagccctacccacatccaccctacttcccaaaagcctgtagaagcccccacttagaaaaaaaggcagacatacacatacacagaaacacatatctatctgcagctcctncnnnnnnannccctgaaacatacacacncnnnnnnnnnnntcnnctncttatggcacagatgggacaggntggcctttcccctgtt

SEQ ID NO: 312 - DNA, 4259 bp, Homo sapiens
  modified_base (104)..(120): a, c, g, or t
  modified_base (326)..(357): a, c, g, or t
  modified_base (956)..(958): a, c, g, or t
  modified_base (967)..(967): a, c, g, or t
  modified_base (998)..(998): a, c, g, or t
  modified_base (1036)..(1036): a, c, g, or t
  modified_base (1110)..(1110): a, c, g, or t
  modified_base (1114)..(1114): a, c, g, or t
  modified_base (1116)..(1116): a, c, g, or t
  modified_base (1149)..(1149): a, c, g, or t
  modified_base (1167)..(1167): a, c, g, or t
  modified_base (1296)..(1296): a, c, g, or t
  modified_base (1368)..(1427): a, c, g, or t
  modified_base (1430)..(1431): a, c, g, or t
  modified_base (1433)..(1433): a, c, g, or t
  modified_base (1435)..(1437): a, c, g, or t
  modified_base (1579)..(1579): a, c, g, or t
  modified_base (1606)..(1628): a, c, g, or t
  modified_base (1860)..(1907): a, c, g, or t
  modified_base (1965)..(1965): a, c, g, or t
  modified_base (2007)..(2007): a, c, g, or t
  modified_base (2189)..(2189): a, c, g, or t
  modified_base (2228)..(2228): a, c, g, or t
  modified_base (2351)..(2353): a, c, g, or t
  modified_base (2355)..(2356): a, c, g, or t
  modified_base (2398)..(2399): a, c, g, or t
  modified_base (2401)..(2401): a, c, g, or t
  modified_base (2486)..(2486): a, c, g, or t
  modified_base (2516)..(2516): a, c, g, or t
  modified_base (2566)..(2566): a, c, g, or t
  modified_base (2616)..(2616): a, c, g, or t
  modified_base (2651)..(2673): a, c, g, or t
  modified_base (2677)..(2677): a, c, g, or t
  modified_base (2683)..(2683): a, c, g, or t
  modified_base (2749)..(2749): a, c, g, or t
  modified_base (2752)..(2752): a, c, g, or t
  modified_base (2756)..(2771): a, c, g, or t
  modified_base (2931)..(2932): a, c, g, or t
  modified_base (2956)..(2957): a, c, g, or t
  modified_base (2963)..(2963): a, c, g, or t
  modified_base (2974)..(2974): a, c, g, or t
  modified_base (3062)..(3063): a, c, g, or t
  modified_base (3122)..(3122): a, c, g, or t
  modified_base (3328)..(3328): a, c, g, or t
  modified_base (3476)..(3476): a, c, g, or t
  modified_base (3481)..(3481): a, c, g, or t
  modified_base (3483)..(3506): a, c, g, or t
  modified_base (3691)..(3691): a, c, g, or t
  modified_base (3696)..(3696): a, c, g, or t
  modified_base (3730)..(3730): a, c, g, or t
  modified_base (3946)..(3946): a, c, g, or t
  modified_base (3968)..(3971): a, c, g, or t
  modified_base (3973)..(3973): a, c, g, or t
  modified_base (3975)..(3975): a, c, g, or t
  modified_base (3977)..(3977): a, c, g, or t
  modified_base (3979)..(3980): a, c, g, or t
  modified_base (3982)..(3984): a, c, g, or t
  modified_base (3986)..(3992): a, c, g, or t
  modified_base (4016)..(4016): a, c, g, or t
  modified_base (4024)..(4024): a, c, g, or t
  modified_base (4043)..(4043): a, c, g, or t
  modified_base (4066)..(4066): a, c, g, or t
  modified_base (4081)..(4081): a, c, g, or t
  modified_base (4102)..(4102): a, c, g, or t
  modified_base (4122)..(4122): a, c, g, or t
  modified_base (4127)..(4128): a, c, g, or t
  modified_base (4131)..(4131): a, c, g, or t
  modified_base (4144)..(4144): a, c, g, or t
  modified_base (4161)..(4161): a, c, g, or t
  modified_base (4170)..(4170): a, c, g, or t
  modified_base (4185)..(4185): a, c, g, or t
  modified_base (4187)..(4187): a, c, g, or t
  modified_base (4189)..(4189): a, c, g, or t
  modified_base (4209)..(4209): a, c, g, or t
  modified_base (4213)..(4213): a, c, g, or t
  modified_base (4218)..(4218): a, c, g, or t
  modified_base (4224)..(4224): a, c, g, or t
  modified_base (4227)..(4227): a, c, g, or t
  modified_base (4231)..(4231): a, c, g, or t
  modified_base (4233)..(4233): a, c, g, or t
  modified_base (4246)..(4246): a, c, g, or t
gtcagtatggaggaggcggaccttgagggagagtaggaattggattgcaagaggaaggagagccttctggccagcagcagccagcagcagtgggggaggctggnnnnnnnnnnnnnnnnngggggctggggcataaggaggggcctgcctgtgaagatcatatgggccaggctgtggagggccaggcatgcccgccgggagtgcagctggtccacgggaagcatctggagtggctgggaatgggcgcaggagcagcgccgtgggagcacaggtctctttcccggggcggctcacctggtgtcttggttcctgcaagccttgaaaannnnnnnnnnnnnnnnnnnnnnnnnnnnnnnnaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccnnnaggccactnaggcggctcccagctgcgttggcgacatggncgacacccccagagatgccgggctcaagcaggcgcctncatcacggaacgagaaggccccggtggacttcggctacgtggggattgactccatcctggagcagatgcgccgnaagncnatgaagcagggcttcgagttcaacatcatggtngtcgggcagagcggcttnggtaaatccaccttaatcaacaccctcttcaaatccaaaatcagccggaagtcggtgcagcccacctcagaggagcgcatccccaagaccatcgagatcaagtccatcacgcacgatattgaggagaanggcgtccggatgaagctgacagtgattgacacaccagggttcggggaccacatcaacaacgagaactgctgnnnnnnnnnnnnnnnnnnnnnnnnnnnnnnnnnnnnnnnnnnnnnnnnnnnnnnnnnnnncannancnnnaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcgnacacactcaccctggaggagagggtcnnnnnnnnnnnnnnnnnnnnnnnagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctnnnnnnnnnnnnnnnnnnnnnnnnnnnnnnnnnnnnnnnnnnnnnnnncttcgaggcgtaccgtgtgaagcgcctcaacgagggcagcagcgccatggccaacggngtggaggagaaggagccagaagccccggagatgtagacgccnccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcntccccgaggttgtggggaggctgcactggagccacaggnaggggtgagagcacccactgaattgacatgaccctctgtccccaggcctggctccccgagggctcagaagagcagcttcggtgtgcagatcatccgtccgtgtggggttctcagtgccggagnnntnngggtgggggccaggcctcgcacttgcagaggagcccagtggnntncacgctcccctccatccccatcggccctgtcccctggagtgtgtcagagcccaggggagaatgcagcccaccaggagcacctggnaccccctgcccgccacatggtgtggccatncactcagcccctacccctgccctgctcctaagggtagaaaactccagggntcccctgccaccgactgcccagccactccaagccccctggcagctgcccntcctggagcagaaagtgcctttatctcagccatcnnnnnnnnnnnnnnnnnnnnnnngggnacaggntggaatgagggaggcgtcttcatctccctgccatccccctctcacgccacccccgcccccaccggnctngcannnnnnnnnnnnnnnntgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtgnnttgggctggtcagagtggcgtganntgcccnggcgcctgccntgcccaagtgaccagggaagtgtgtgtgtgtccatgtgtatgcgtgtccgtctgtctgtctagtgtctgggtttggcccaagactggnntgtagttacattaatgcccagccagccacccctgccactcacccctcctggcccaggcnttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgagggnacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctnggctncnnnnnnnnnnnnnnnnnnnnnnnngaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcnccagnccatgtggcctgcccagcctcaatgtcacttggnggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccanaaaaaaaaaaaaaaaaaaaaannnnanananannannnannnnnnntgtacaaaaggggtcctgctgtgnttgttaantcagtttcccctcttggtnaccctagctggaagagggggggncccggtacccaattngcctataggtgagccgatttnaatttaatggccgtggtttnaacgnngtncttggaaaccctngggttcccacttattgntttagaaanccctttgcacttggnantnaagggccgccgttgcttcanagtnccgtnatgggntgnattnangtaatttttaaanggaattttaaaac

SEQ ID NO: 313 - DNA, 3835 bp, Homo sapiens
gcataagtttttttttcttaaaaaaacggcatctgcttaaagggatttatgactaaaattgcttatttttctacagagttgtctgctggttctcagcttgaagaagattctgaagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggttctggccccttacaagagagatctctctttgagaaaaagagaggcgctccttcaagtagcaatattgtagacgttcattggactcttaccgaaagggttatccccatctgtgctctatatgtgattggccaggtcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccagaggaatctgggtgctggaaatggaacctgcaaggacctagacacatgcagaaaggcagagtggaaacttagcagagttgttcacatcatgggtttttcaacggaggaaaaaactttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatgtaaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaaaaaaaaaaaaaaaaaaaa

SEQ ID NO: 314 - DNA, 2056 bp, Homo sapiens
ggaaccgcggctgctggacaagaggggtgcggtggatactgacctttgctccggcctcgtcgtgaagacacagcgcatctccccgctgtaggcttctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagcctccaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccaccc

SEQ ID NO: 315 - DNA, 2262 bp, Homo sapiens
gctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 316 - DNA, 3667 bp, Homo sapiens
  modified_base (3)..(8): a, c, g, or t
  modified_base (14)..(23): a, c, g, or t
  modified_base (64)..(68): a, c, g, or t
  modified_base (399)..(399): a, c, g, or t
  modified_base (2090)..(2090): a, c, g, or t
  modified_base (2170)..(2170): a, c, g, or t
  modified_base (2257)..(2257): a, c, g, or t
  modified_base (2445)..(2445): a, c, g, or t
  modified_base (2529)..(2529): a, c, g, or t
  modified_base (2550)..(2554): a, c, g, or t
  modified_base (3592)..(3594): a, c, g, or t
  modified_base (3596)..(3596): a, c, g, or t
  modified_base (3598)..(3598): a, c, g, or t
  modified_base (3600)..(3600): a, c, g, or t
  modified_base (3602)..(3603): a, c, g, or t
ttnnnnnntttttnnnnnnnnnnttttttttttttttttttttttttttttttttttttttttnnnnntgcataaaacaagtttaatttccaaccagggtcacagtcatcgcgttatcccacattttgagcaaggatagagaaggtgagttattaaacatatacagtctacattccagaggaggaactgcagttaccactataacaccacagacaaactttggggtggggggagcgggagtcctcaggaagcagaaagctggaatcagggaaagcataaaattaaacctaccagagaggagaggagagggagtgggcagaaatggaatgaaacacccaatcccaaaagagctgttaagtgaatgggaatgtagaaaggaccacccctgccaagggcttnagcagccagggatactaccaagatcacttactgccccctgctggacagatctggggcagcaccaaggcaacctcctaacatttccagccccagattggtccctggagcccccaaaaaaacaaggtgaggggtgaggcctgaagtgaggaaaacctatttaggactgacatctaactagagaaagtcagggaatgaggcaggagaagaggcaaagtcctcatgaaccacaaagatagagtggaaaatcctaagtaggaaaaaatacatggaaaagggcaaatgagcaacagcagtgaatgagttgagattgaaaaggaaagagttcaaggaaggagaggcaatggggcaagacaaaataaatctgaggaaacagagcaaataaaaagtatggagggaagcatctgtggggccagggaaatgaatacatttttaaatgaaatagaacctccaacaccccccccacaaccaccacacacaaacacacccacacccatatacacacacactcacacacacacacaggcctagagagcaagatacctgcacacacctgctgcatcctgggtaacacatcactaagtaactggcactgagggagatacccctggaacctctctttcacagttcaatcttggatggggttactaatattgatccatctgctatcaacaaaagtggccaggaaacctggccccatggagtggggcttgggacagccctactgggaaggggtccctcagccatgctgtggggggccctgggccctgaccttagcaggttatgggcagctgtctcggagctcagggcgcagccagcacacacaggagcccacaggacagccacgtcttcacagaaactacagaagtcaggacccaggcgaggacctcaggaacaagtgccccctgcagacagagagacgcagtagcaacagcttctgaacaactacataataatgcggggagaatcctgaagaccactgcatcccacaagcactgacaaccacttcaggattttatttcctccactctaacccccagatccatttatgagaagtgagtgaggatggcaggggcatggagggtgaagggacagcaaggatggtctgagggcctggaaacaatagaaaatcttcgtcctttagcatatcctggactagaaaacaagagttggagaagaggggggttgatactaaggtcagctatgtcaccccacttcccagctcctcattagaatacccagtcagccctggtcaggccagtaggagtactagggtgagaaaattctgaccaaggacagatgacccatccaacccctaagatcagaagggtggtggggcactggaaggcaggaatgggattggcccatgcctcaccttctcctaataacaaaagagaatgaagatggaaaacctcaggccttcgcctcccttcccccaatgccctgggtccctaacacacaccatggacttgccatccccaccccccagtcaagctccagaggaacagatctgaagatggtggggaaggatcagttgaacactctaagctgataagagtgagtgggttcctctctccttcccaacagtaaggcagagcagagtggcatctccttgggaacagtcatctagagataaatgccatcctccagccctaagaagggtggagagaagagtacaaggaaaatggtggtgnagaatccatcatctgtcctatcatccagaaaaacctacctgcagagaggagggtaaccagtcaaagactggggcagtccngcttgactaatgccctcccaccttcttcccttaatctcaccaacacggaaggggcagatgacaggctccagtgggcagtgtcctggnctgcaagccctgagcttcactccaccccctccccgctccccccggcccccacaaatatatctctctatacatgtatatacaggcgcacacatgcacgcaaacacagagaggcccgtgcaatttccatgtaaaacagggagagggtggcaaaggaaaggcaaacagggagtagaagggcttgtgggganagggaaaggactcagatgccaagaggacagcaaccactgccaaacaaagagaataccccactcgacctcccgaaacccagaggntgagagagagagaggggccannnnntgaaaccgtaacaactttttgttttaaatccagtaaattggaatgactcatcatcaggacagcaattagggattggtcatataggtggacaggaaaaaggaggggaggcaggggaggcaaggctcttgctgggcatgtggacatgatacccagggccctggccacacttgcatggagaggaaggggtaggactggggcagggtgacagtaggtatgtcaggggtgggtggggtgctttgttagggctgtctggctttcacttcttgtttttgagctgattggccagccagtccaggccttcgtacagcccgtccccgctggtggcacaggtggcctgaatgtaccagttacggtgacgaagggaatgcaggcccagcttgtctgtgatctcagcagcgttcatagcattaggcagatcctgtttgtttgcaaagacaaggagtacagcatcccggagctcgtcctccgccagcattctcatcagctcttcccgggcctcatttactcgctcccgatcattgctgtcgaccacaaatatcaacccttgggtgttctggaagtagtgtctccagaggggtcgaatcttgtcctggccacccacatcccacactgtaaagctgatgttcttatactccactgtctccacattgaacccaatggtagggatggtggtgacgatctcccccagtttcagcttgtataggatggtggtctttcctgcggcatccaggcccaccatcaggatgcgcatctccttcttcccaatcaggctcttgagaaggtttccaaagatattgcccatgatcacagcagctgctttctggggacagtggggcccaagtaggggcagtggcagtctggttttggcctggtccctggtatggaagacttgatcctgttcctgctatcagctgcgccgctgcggccgccgcctctgccccgcaggttccgctccgctccctctggctccccaagccgacttcagcccggctgctgcctggcccactccccggctccctccttccttccctccacctnnncncngnannccgcgacggcgactggagctgtgcggcgtacccccacccccagcccgggatacttcccacctcc

SEQ ID NO: 317 - DNA, 1890 bp, Homo sapiens
gacccacgcgtccggggaggagaaagtggcgagttccggatccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattctacgggcccgaggggccgtatggggtctttgctggaagagatgcatccaggggccttgccacattttgcctggataaggaagcactgaaggatgagtacgatgacctttctgacctcactgctgcccagcaggagactctgagtgactgggagtctcagttcactttcaagtatcatcacgtgggcaaactgctgaaggagggggaggagcccactgtgtactcagatgaggaagaaccaaaagatgagagtgcccggaaaaatgattaaagcattcagtggaagtatatctatttttgtattttgcaaaatcatttgtaacagtccactctgtctttaaaacatagtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgttaatactgtttttcttctatctgtagttagtacaggatgaatttaaatgtgtttttcctgagagacaaggaagacttgggtatttcccaaaacaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccactaaaaaaaaaaaaa

SEQ ID NO: 318 - DNA, 2493 bp, Homo sapiens
aactgagggggtggctagcagcaaacaagtatggagctagcacaagagctaagaaataacctccatccctaccactcagcacacaacccctacggtcccagcacactgagccctggctcccaagggctgcctcctgacagctccgtcatggcactttttaacgcttcagcaacaaacaccaggcagctgttgccactggcctcctacccctactctggggcttgggggtcactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctggtacccatcctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttcccaggtttcacactcaatttgatatccattaccatgtcttttctacttccttgtaaataggtatgatctttattcccactgtacagtctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaaggcctcaattcccttccttttccaaggggcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctgggaaaccacttccccaggcttctccctccccccacccccataggaacaggatttggccttagcttcgtgggcctatcggctgccttccctctacttcctaccacctcttctgccttcctttgagctctgttgggcttggggatcttagttttcttttgtttatttcccagctcatttttttcttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaa

SEQ ID NO: 319 - DNA, 3500 bp, Homo sapiens
agaatttgtttgtaaggtatgggaaggtcggtggcgagtgatccctcatgatgtactaccagactggctcaaggataatgacttcctcttgcatggacaccggcctcctatgccttctttccgggcctgttttaagagcattttcagaatacacacagaaacaggcaacatttggacacatctcttaggttgtgtatccttcctgtgcctggggatcttttatatgtttcgcccaaatatctcctttgtggcccctctgcaagagaaggtggtctttggattatttttcttaggagccattctctgcctttctttttcatggctcttccacacagtctactgccactcagagggggtctctcggctcttctctaaactggattactctggtattgctcttctgattatgggaagttttgttccttggctttattattctttctactgtaatccacaaccttgcttcatctacttgattgtcatctgtgtgctgggcattgcagccattatagtctcccagtgggacatgtttgccacccctcagtatcggggagtaagagcaggagtgtttttgggcctaggcctgagtggaatcattcctaccttgcactatgtcatctcggaggggttccttaaggccgccaccatagggcagataggctggttgatgctgatggccagcctctacatcacaggagctgccctgtatgctgcccggatccccgaacgctttttccctggcaaatgtgacatctggtttcactctcatcagctgtttcatatctttgtggttgctggagcttttgttcacttccatggtgtctcaaacctccaggagtttcgtttcatgatcggcgggggctgcagtgaagaggatgcactgtgatacctaccagtctccagggactatgaccctaaaccagggcctgcggcacttgcgggcctccctgctggctactgatgccagtaccagaggagccccaaaactttgacagcctcgtgggctttgtgacggcccaggggctctgcgtggtacatgactgagaagagaaaaacaaaaataaatcatacctcaaaggatggagtgcatcaattgggagaaaaggagacatagcccaaaccctggcttattcttgggatctactgattgcgggctctgcaagacccttggcaaactggcttctgatccatatcatatttatttgtagaagatggcgaaacagtttagctggtggttctttcttctccctttctctctctctatgacaataatacaaaccaatttaagtgaacatttatatccgataaggggtgggagtgtgattttaaatgctcttttgggagaacaaagaaattaatgtaaataagatttctaactgtttaaataagactttatataaatgtttaaaacataggggtaagggagggagggagaatttttgtatagaatgaaacatgcaagtaccacacactgtttgaattttgcacaaaaagtgactgtaggatcaggtgatagccccggaatgtacagtgtcttggtgcaccaagatgccttctaaaggctgacataccttggaccctaatggggcagagagtatagccctagcccagtggtgacatgaccactccctttgggaggcctgaggtagaggggagtggtatgtgttttctcagtggaagcagcacatgagtgggtgacaggatgttagataaaggctctagttagggtgtcattgtcatttgagagactgacacactcctagcagctggtaaaggggtgctggaggccatggaggagctctagaaacattagcatgggctgatctgattacttcctggcatcccgctcacctttatgggaagtcttattagagggatgggacagttttccatatccttgctgtggagctctggaacactctctaaatttccctctattaaaaatcactgccctaactatacttcctccttgagggaatagaaatggacctttctctgacatagttcttggcatgggagccagccacaaatgagattctgacgtgtccaggtttctcctgagctcatctacatagattggtagacccttcctttggattaggaaagatgagttttacctctggtacactgtcttggtaagcctggatgtgacagacacctcggctctccttgaataagaaagccagcagaactcttaaagccagttgtagtacggagttgtcagcactcactgaacctcactttacagggataagagtggtgtggcattttaaatacaatggtatgttattgccagggagtgaggtacaagacgatggctcatgtcacaggcctacctgatacggtgtcagagaaagtggtggggaaaggatctggttcatggaattctgatcttggcccataggtgaaccaccaaaatagtgctcgagtcttaggttactgtcatcaaagacttgggatgactccattatatcctggggttgtgggtattagaactaaatatggaggtcctgagcatggggactggtgtcctcagtaggtgtttgggaatatgggaagggtctcctatttattcaatagagttttctcagttattttcctccctcgcccttgcaatctccagcaaaaggtgggatctaggaagaaagaatccagtgtagaagttgagaagaacttgaacgttttggttctggataaggtcactgtcctaggtgctaggtggaccgagcaaaagactcagtggatgaactggtgcagtgcctgacagaataaagaacagtattaatccctttgagaaagcatagtccagcaggacagtggccatttggacagaagcccacttagtttcttgggagcaacagcacgtatcagaagccagacttgctcttcggtcatgcactttgggatacagcgtataggtgcagccctgtcacaacaccaacagaagtagcagcctctgggtgcagtcacccacaccccaaagctggaaggatctggttcaacatagcacaaacccttaggaaaaatgaaattaacatcactgatgtgtaatccagtaaaatctccctttttcgggtgtgtatgtgggcatgtgcccatttctatgtgtgtgtctacgtgcagctcactaccaacagcctcatgtgcacttgacctgacagtgctcgctgagaactctcaccaggttggcgcctgaatgccttactctcagcagtcagaggcttgcttgctctgtgcagatttttaattttcttttttggccctaggctggttgggacctctacagcttcattctttcacattaaatagtgacctttttcagtattttccctcttcccctttataaattatgctaaagccacaaagcacatttttggggatcatagaaggttggggttccagaaaggcatctgtgtgatggttccattgatgtgggatttccctacttgctgtattctcagtttctaataaaaagaaccaaatgaaaaaaaaaaaaaaaa

SEQ ID NO: 320 - DNA, 3650 bp, Homo sapiens
  modified_base (9)..(10): a, c, g, or t
  modified_base (17)..(18): a, c, g, or t
  modified_base (536)..(549): a, c, g, or t
  modified_base (3166)..(3166): a, c, g, or t
  modified_base (3530)..(3530): a, c, g, or t
  modified_base (3532)..(3532): a, c, g, or t
  modified_base (3536)..(3536): a, c, g, or t
  modified_base (3538)..(3538): a, c, g, or t
  modified_base (3541)..(3543): a, c, g, or t
ttttttttnnttttttnntttgcatatcacaaagttttattaatgtaattttaaggccaattaaactaattttattcaaagtaagtctacattaaattacaatattaacaatctctagacacaacgaacttataagaaaaaaaaatagaaatctgtttggtctttcttagaccacatatcatggaactcataaatgaaaattttcaaagatagaaatgacaattaaagagtgaggattttaatatggaaacccacaaggtgtcatatttcaaacccgcatgtttcaaaaagagactcttaataatttagcacaaaatcaaattatataaacttggtatattccagaaaatattgctttaaacacttatgccatgatcaaaattcctttggtagcttttaatcaaaatgaaacatgctattatgtaaaatataaagtacttttaaatgttatctcaaaagtatctttgtcatagttacccttctaacatcactactgaactttcctttcactgttcaacctcatgtatatatacacnnnnnnnnnnnnnntaccaacaaaatccttttaatctttccacaaaataacctctgcttcacaacatcaagactttaagtctccataaactttttacagtttacagcagagaacaaggatcgtccctgcgcatgactgtaaaaaccaaaccaaactttattattgcaatcacacaaatactgcaattaaaaaaaatcaaagagcagttaccccaatgcaaaaaaacagggactgccagactcaatcttagaatggaaacacaaacacactagccccaaaccctaaaacagagattcacaaggaactcagctgacgaacagacgcagcagggcggacaccatggccttggcacctcagggagctcacttagaaacctgacttacgaaaaatcagccatcaaagtttacaacttttggaaatacatgaaacagagaggggccagtggctagggtgcgtcatccattcgccagctttgaaccctggctctttctaatgttcacccatgaagggcccttgttttcactctaaatgctgatcatctgagcgagctgtcttcagggatacctaaggaatcttcagagctaaaaaatgcagcatctagggtcttcttcattgtgcactcatgatcacacacgagaacaaaccaaacttgcagctttttgacacaagaacaagaccttttaaaggaacttctctttagtaacatcttcttgtccaatctcaaagttattttgcacagagtaacagaaacaatttaaatgcctaaaagaactagaggaaaaactggagggaaaaagatacatctgcaggttgaagtcttgagccttgtgaaagatgacccaggagccacctcccttccttcgccttccaatgtccacagctggatcaatcagagtcccagaaatggcacaggtgtgcttcctgctctgagggtacattctagtgtttcatgaaggggaaccgtctgcagatgcgtcaggccacgtagtggtactgattcggattgtctttgtctctctccatatagtctctgtctatcagagattcaattctctttttcaaatctccaggctttactggaaatttcagctgattatataattcagaaactagaagattatgaccaagagtctttctcatcttcattattctgacgatagcagcatcaatctgatattgtctatcctgaaacactctctcagtggtgctaacctgttcctcaacagtttccttcatctgaatttgattgatctttattctaaacaacttgtgcttgaactctccattaaaaatgaacttgtctccatcttccacttcctttcctttgggacttttaatcagcacacgtgctttgccacaggccagggactgcagcgttctgcgcaattcactatcctctatccccgtggccatttttatctcctcaaagctgaagccatctccctcgttgaacatgaggagcaccagtgtctggaagagggacacctggaattccttcttcccttctttaaactccgcttttaaaacagcatgtcccaaagtagtttgccactgaagttttcgaccactgtgctttccaagataaaatgccttaaatacttcctgaagtttaatcatttctggggttaagtgcacttccatgggcgtgtatgttggccagtagcccattgtgagtatgttcactgtgaggtctatagggcctgagtcactctgattctgcatatgctgcttgaaatgaaccatgatgtccttcgaaagctccatgtccttgaacatgccttccagcttgctggtgaaggctgcaccgcactcatgcttgagctttgacaacatagacttttcagcatcgactgaggcacttttcccaacaaggagtctttttgccaaatcttttttataaaatgcttcaaagacatctttaccgtggataaacctgaacaggatcatgatcttgtccaacgtccgctccagctcctcgtctgtggcttctttgttgcctgctcttaactttgaatccacatgctttgcgatcagttctgcaggcttgttgggtctcttgttgatgaacgtctcaaaggactccttcatcaggttgacgaaccgctcattcttctggaagcagacctcgatcacgtggtccaccttgtccttgaagtccaacaggtcttggaccatgtctttgtctttctcaggattgattacgatcgctgttccaaaagtcttgatgtactcgctccagtgctgcagcagcgcctgctgcccgcccctcacccggctgaacagctggtacatctgtgcgaggtccggcactctgttctcatccagtaagtggtcgagccctttctgcagaattgctgttaaatgttctcctaatagctgtttctccacacaagcaatcagtggtttctgtgtgctgtggtccaagtaagtgattactctgtctccctcttcctctaagcgtttacttacatggttaagatattctggaacctctctttcctgcattaacctttggccttcggcagcatataagcaattagtctcttccaaaaatttcagttcaaatgaatctttatacacctgcaggtcagacagcatgcccaggaggctccgcaacaggctccggtccanggcctcgccgctcctctcgcgctcgatcagcagtaggattccatcaatggttttactctgaaccattttatcactaataatatgggttctaaacagttctaatcccatatcccagatggagggcagcgtggagttctgcagcacataggtgcggtccaagaacaggaagatgcttctgatcatgatcatttgtctgcagtggtcctgccagcacgtgttaatcttctttaaaaataaaacactatctagtgagtcttctctaaacggaaggatctgtgcctggacgtggtcttcacaggcctgacgcagttgcttgtagagcattggggagactttgtgagaacagagattttccacagcctgntngagntnctnnnctgcacggcccgcaccgcctcgtgcagcttccgccacgtgtcctgcgtgtagttgtcgggcagccgaggtctgtaatcagaaccgctggcgtcccggctgagaagac

SEQ ID NO: 321 - DNA, 2519 bp, Homo sapiens
  modified_base (26)..(28): a, c, g, or t
  modified_base (30)..(31): a, c, g, or t
  modified_base (513)..(513): a, c, g, or t
  modified_base (605)..(610): a, c, g, or t
  modified_base (612)..(614): a, c, g, or t
  modified_base (804)..(804): a, c, g, or t
  modified_base (806)..(806): a, c, g, or t
  modified_base (808)..(809): a, c, g, or t
  modified_base (812)..(812): a, c, g, or t
  modified_base (814)..(814): a, c, g, or t
  modified_base (1533)..(1533): a, c, g, or t
  modified_base (1823)..(1823): a, c, g, or t
  modified_base (1871)..(1871): a, c, g, or t
  modified_base (1895)..(1895): a, c, g, or t
  modified_base (1898)..(1898): a, c, g, or t
  modified_base (1932)..(1932): a, c, g, or t
  modified_base (1936)..(1936): a, c, g, or t
  modified_base (1938)..(1938): a, c, g, or t
  modified_base (2037)..(2037): a, c, g, or t
  modified_base (2060)..(2062): a, c, g, or t
  modified_base (2470)..(2470): a, c, g, or t
  modified_base (2474)..(2474): a, c, g, or t
  modified_base (2476)..(2476): a, c, g, or t
  modified_base (2478)..(2479): a, c, g, or t
  modified_base (2481)..(2485): a, c, g, or t
  modified_base (2487)..(2492): a, c, g, or t
tttttttttttttttttttttttttnnntnntattaatttcatgtttatttcatacagggtttttgtcaagtttatcagttttaaaatgattaagtcataatcaccattcaaagacaaattttcctctcaaaataataatttccattctgctacctacagtttggcttatcctttggtctgatagccatacttcatctcacaggactatacaagtatgtactatgtacaaaacattttcaagtttgctttcaaatgatacctacaaagagtagatcaagttttcaagtttacagaataccatactacaacaatttaccactataaatatgtcttaacacctgtttattccattctatttagattgcaacactaacaagattcttaatgcatatgtccccaccacctgtactttccctacactatcattttgacacttaacatagaaacaactcaattcagcaaccaagttttacaaccactgttgctaccaatcaaatggtgatgcatcagancccaattctcatgagtattaacatattaagagagtacattatttacctaagactgaatgactgtgccttactttataaaaaaacaaagatannnnnntnnntttaattccatatatatgatactacctattcaatttattaaaaattgtaataaacataataatcaaactagtgctccaaacttatgctgttcacatggaagacaccacaaaagaagacataatatagagacttgccttgcaataagaagtacaaattccttctataaagatggagaaataaaaggacaantntnnttntntaaaagacaattcactgtacacattttatttacagttttgtacactgtcttaatatgaatgggactgcttttctacttgagccatttttaaccaaagcaaaataacctaagtaatacaaagtgttaaaatacagcataaagatacaaaaacagacatactaattctagttaggaatgtaattatgatgttacattttttataatccacaattatgtttaggaaatcacacaaacatagatcactgatttgaatgaaatgcataaatttgtagcaaagctttgtagttacaaaaaacaaaaaaaattaccaaagaatgcacaaaattaatgtttattccacctttgtgtcatattcctggatccttcaccaatgttacatgaggaaaaaaacaaaaaaaatttaagcaaaacaaatgaaaaactgaaatcagaatcactaatattatcaagtagggaaacaaataaattaaaatctagcagccatcagcaagagtacagcaaagacaatgctgtaaaaagaaacaaagaaaattgctagaaaactgtatgcatcataatctttcaaaccagcaaaatatgcttctgcataaaatggaacaacagaattttttttcctgtaaagtatagaaatgccaagttgttttctgactattgtggataggtaaaatctgtatgtaattaatggtaattctactgaactattacagagtgggccaggnaacacatttatggattctggggatgtgtactgtaattctttgattgggatagtggaaactctagccaaaaaaaaaaaaaaaaaatgaacacagaagtacaagacaaaggcgaatgagacttctcttatatctgagtaacattaagatggaaatcaaatttaaatgcagtccactctgctttttgaagaggctttggttcagctcccaaatctcgattgcttgacgcagtctcctatgagaatactcagaaggtgtcttcttaaacaacaaacctatttttagtggtgganccgctcttagtagctgtgtctgcgtgggactgataaccaatcactatnctttggaggaagtcctaacctttnccnttgtataccctccctatatgtgtaacagcttctnctgntntttcacattcagtagtccatattgctatcttatcacctttagctctaacattaacaacagcgccacatacatcatcactgtagtcatcaaaagattctnccaataaggcacagaagtgtctnnnctagccaaaagcgatcgaggtcacttcgtctctgctgtttgttcaatgtaattagccatcgtcctccccgtttgtttttctcatcttcccacataggctcaataccatccttaaaaagtgagtagtcacagccaggcattaaattactagacaactggatatggttgtacagagcccaaaagtcttcaacagtatcaaacttggagatcagccgcaggtttgcttgccaagttttgcttttatcatttttaaaaaaccagagtgcccatctgttctgtaggggatgtttaatatagtgttctgggttagcaacctcctgattagattccgttttctcctcttctgtagtcgggggattaggagtaggggtggtttccggttcgacagtcgccatcttagatcgatctnatcncncnncnnnnncnnnnnncccctcttcggggacgcgcgcgtggcc

SEQ ID NO: 322 - DNA, 647 bp, Homo sapiens
gctcactgagcaccgtcccagcatccggacaccacagcggcccttcgctccacgcagaaaaccacacttctcataccttcactcaacacttccttccccaaagccagaagatgcacaaggaggaacatgaggtggctgtgctgggggcaccccccagcaccatccttccaaggtccaccgtgattaacatccacagcgagacctccgtgcccgaccatgtcgtctggtccctgttcaacaccctcttcttgaactggtgctgtctgggcttcatagcattcgcctactccgtaaagtctagggacaggaagatggttggcgacgtgaccggggcccaggcctatgcctccaccgccaagtgcctgaacatctgggccctgattctgggcatcctcatgaccattggattcatcctgttactggtattcggctctgtaacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtga

SEQ ID NO: 323 - DNA, 7560 bp, Homo sapiens; identical to SEQ ID NO: 97

SEQ ID NO: 324 - DNA, 3543 bp, Homo sapiens
  modified_base (79)..(79): a, c, g, or t
  modified_base (98)..(98): a, c, g, or t
  modified_base (124)..(124): a, c, g, or t
  modified_base (453)..(453): a, c, g, or t
  modified_base (468)..(468): a, c, g, or t
  modified_base (478)..(478): a, c, g, or t
  modified_base (487)..(487): a, c, g, or t
  modified_base (502)..(519): a, c, g, or t
  modified_base (521)..(521): a, c, g, or t
  modified_base (531)..(531): a, c, g, or t
  modified_base (535)..(535): a, c, g, or t
  modified_base (562)..(562): a, c, g, or t
  modified_base (1393)..(1393): a, c, g, or t
  modified_base (1923)..(1923): a, c, g, or t
  modified_base (3483)..(3484): a, c, g, or t
  modified_base (3492)..(3492): a, c, g, or t
  modified_base (3495)..(3495): a, c, g, or t
  modified_base (3498)..(3499): a, c, g, or t
ctcgtgccgaattcggcacgagaccgcgtgttcgcgcctggtagagatttctcgaagacaccagtgggcccgtgtgganccaaacctgcgcgcgtggncgggccgtgggacaacgaggccgcgnagacgaaggcgcaatggcgaggaagttatctgtaatcttgatcctgacctttgccctctctgtcacaaatccccttcatgaactaaaagcagctgctttcccccagaccactgagaaaattagtccgaattgggaatctggcattaatgttgacttggcaatttccacacggcaatatcatctacaacagcttttctaccgctatggagaaaataattctttgtcagttgaagggttcagaaaattacttcaaaatataggcatagataagattaaaagaatccatatacaccatgaccacgaccatcactcagaccacgagcatcacntcagaccatgagcgntcactcagancatgagcantcactcagaccacgnnnnnnnnnnnnnnnnnnancatcactctnaccntaatcatgctgcttctggtaaaaatangcgaaaagctctttgcccagaccatgactcagatagttcaggtaaagatcctagaaacagccaggggaaaggagctcaccgaccagaacatgccagtggtagaaggaatgtcaaggacagtgttagtgctagtgaagtgacctcaactgtgtacaacactgtctctgaaggaactcactttctagagacaatagagactccaagacctggaaaactcttccccaaagatgtaagcagctccactccacccagtgtcacatcaaagagccgggtgagccggctggctggtaggaaaacaaatgaatctgtgagtgagccccgaaaaggctttatgtattccagaaacacaaatgaaaatcctcaggagtgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattntgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactntggcctggatggtgataatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctagttaaggtttaaatgctagagtagcttaaaaagttgtcatagtttcagtaggtcatagggagatgagtttgtatgctgtactatgcagcgtttaaagttagtgggttttgtgatttttgtattgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtgtttaggaataagaatgtgcatgaagcctaaaataccaagaaagcttatactgaatttaagcaaagaaataaaggagaaaagagaagaatctgagaattggggaggcatagattcttataaaaatcacaaaatttgttgtaaattagaggggagaaatttagaattaagtataaaaaggcagaattagtatagagtacattcattaaacatttttgtcaggattatttcccgtaaaaacgtagtgagcacttttcatatactaatttagttgtacatttaactttgtataatacagaaatctaaatatatttaatgaattcaagcaatatatcacttgaccaagaaattggaatttcaaaatgttcgtgcgggtatataccagatgagtacagtgagtagttttatgtatcaccagactgggttattgccaagttatatatcaccaaaagctgtatgactggatgttctggttacctggtttacaaaattatcagagtagtaaaactttgatatatatgaggatattaaaactacactaagtatcatttgattcgattcagaaagtactttgatatctctcagtgcttcagtgctatcattgtgagcaattgtcttttatatacggtactgtagccatactaggcctgtctgtggcattctctagatgtttcttttttacacaataaattccttatatcagcttgaaaaaaaaaaaaannaaaaaaanaanaanntagcttatagggatataaaaaaaaacttttaggggggggcccca

SEQ ID NO: 325 - DNA, 2489 bp, Homo sapiens
gcacgagggggtagagggaaaagagctccgggccaggggctgccgtcgccgccgtcggggagtcagcccgccagcccgccagctcgtcagcccgccaccagcttcgcgggccctgtcggtcccggtaagcgggcctgcgcttaccggaaagaggagcgtaagatgaaagagtatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgcccagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattcttacatattctgaaccttttctccccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaatttttactgaatctgtctaccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaaccttgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaaaaaaaaaaaaaaaaaaaaaa

SEQ ID NO: 326 - DNA, 4417 bp, Homo sapiens
  modified_base (129)..(129): a, c, g, or t
  modified_base (133)..(133): a, c, g, or t
  modified_base (135)..(143): a, c, g, or t
  modified_base (536)..(536): a, c, g, or t
  modified_base (766)..(766): a, c, g, or t
  modified_base (768)..(770): a, c, g, or t
  modified_base (772)..(772): a, c, g, or t
  modified_base (1806)..(1806): a, c, g, or t
  modified_base (2084)..(2084): a, c, g, or t
  modified_base (2350)..(2350): a, c, g, or t
  modified_base (2440)..(2440): a, c, g, or t
  modified_base (2451)..(2451): a, c, g, or t
  modified_base (3109)..(3122): a, c, g, or t
  modified_base (3214)..(3214): a, c, g, or t
  modified_base (3244)..(3244): a, c, g, or t
  modified_base (3296)..(3296): a, c, g, or t
  modified_base (3318)..(3319): a, c, g, or t
  modified_base (3331)..(3331): a, c, g, or t
  modified_base (3337)..(3337): a, c, g, or t
  modified_base (3357)..(3357): a, c, g, or t
  modified_base (3421)..(3421): a, c, g, or t
  modified_base (3542)..(3542): a, c, g, or t
  modified_base (3723)..(3723): a, c, g, or t
  modified_base (4150)..(4150): a, c, g, or t
  modified_base (4356)..(4357): a, c, g, or t
  modified_base (4359)..(4359): a, c, g, or t
  modified_base (4371)..(4378): a, c, g, or t
  modified_base (4382)..(4384): a, c, g, or t
  modified_base (4392)..(4392): a, c, g, or t
  modified_base (4394)..(4396): a, c, g, or t
  modified_base (4398)..(4406): a, c, g, or t
cccttgcctactgctcatgggtgtggagactgatattctggaagactgataggcagatttactattaacaaacacatagtctgtggcccagcaaagccaccccaatccctgcacaagggtaaaaggccngcantnnnnnnnnnagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaanagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtntnnngntgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccccacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttccnggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatntgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggncacccctgagaacatgcctacctgctgggtgccgtctgtgcgttccagtgaggccaaggggtcctggccgggttggggagccctcccatnaaccctgtctngggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcnnnnnnnnnnnnnnccctgggacatgaacccacctgcgtggaatgctgtttgtgaggtgtctacagggtttatagtagtcttgtggacacagaaatgcacaggggnacacttacggacacagaaatgcacaggggnaggccgagcataaccaggggtgaggggcaggcagcagttgtagttactgccngcggggcactgctatgtgcagnnggacagccagcncccagncccatcaccactccctgggnctggctggcaggtatggcaccctgggagcccggcatatacccagggcacccctacggctgccgncagtctcatgcccaggtgggtgctctgggctggagcgagggccaggttttgggccgaggcttccccaggcaatcctgtgagctcccttctagcctctgacccagtctggtctggcttgcantggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctcctnatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcggtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctnccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttannanaaaaaaaaaaannnnnnnnaaannnaaaaaaanannnannnnnnnnntgatgtcgacc

SEQ ID NO: 327 - DNA, 3740 bp, Homo sapiens
cgctgggatggccgccacagctgtaggtgctgctagtgtttagcgctggtctttgccgggcgttgagggcagctcagcctccttgtttgtccggttcgcctgtgcgtggtactcaagggcaccagtattcccgcggtcggcagcatgggtcgggagtcacgccactatcgaaaacgatcggcatcccggggtcgctctggaagtcggtctagaagtcgctcaccctcagacaaaagaagtaaacgtggagatgacagacggtctagaagtagagatagagataggaggagagagaggtctcgtagcagggataaaagaagatctcggtcaagggacaggaagcgtctgagacgttccagaagtagagagagagacagaagccgagagcgaagaagatctcgaagtagagacaggagacgctcaaggagtagaagccggggccggcgatcccgatcctccagtcctggaaataaaagcaagaaaactgagaatagatctaggtccaaagagaaaactgatggtggggaaagttctaaagagaagaaaaaagacaaagatgacaaggaggatgaaaaagaaaaagatgctggcaactttgaccagaataagctggaagaagaaatgagaaagcgaaaagaaagagtagaaaaatggcgagaagagcaacgtaaaaaggctatggaaaacataggagaactgaaaaaggaaatcgaagagatgaaacaagggaaaaagtggagtttagaggacgatgatgatgacgaagatgatcctgcagaagctgaaaaggagggaaatgaaatggagggtgaggagttagatccattagatgcttacatggaagaagtgaaagaggaagtaaaaaaatttaacatgagaagtgtaaaaggtggtgggggaaatgaaaagaagtctgggccaacggtcacaaaagttgtcactgttgtgacaaccaaaaaagcagttgtggattctgataagaagaaaggtgagctgatggagaatgaccaggatgccatggagtattcttcagaggaggaagaagttgatcttcagacagcccttacagggtatcaaacaaaacagcgaaagcttctagaaccagttgatcatggaaaaattgagtatgagccatttaggaaaaacttctatgttgaagttccagaactagcaaaaatgtctcaagaagaggtaaatgtgtttcgattggaaatggagggcattacagttaaaggaaaaggttgccccaaaccaattaaatcctgggtccagtgtggaatttccatgaagatcttaaattccctcaagaagcatggctatgaaaagcccacgcccatccaaacccaagctattcctgctataatgtctggacgagatttgattggcattgccaaaacaggaagtggaaagaccattgcttttctgttgcccatgtttagacacatcatggatcagaggtcattagaggaaggagaggggccaatagctgtcatcatgactccaactcgagaactggctttacagattactaaagagtgtaagaagttttccaagactttgggacttagagtggtctgtgtttacggaggaacaggaatcagtgagcagattgctgagctgaaaagaggtgctgaaattattgtttgcacacctggtcgaatgattgacatgttagccgctaacagtggtcgggtcacaaatcttcgaagagtgacatatgttgttttagatgaagcagacagaatgtttgacatgggttttgaaccccaggtcatgcgcatcgtggataatgttcgtcctgatcgacagacggttatgttttcagctactttccccagagctatggaggctttggctcgcaggatcctcagtaaacctattgaagtacaagttggaggcaggagtgtggtttgctcagatgtggagcaacaagtgattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggcattgatcaatatgacagagatagcatcataaatgactttaagaatgggacctgcaaacttcttgtggctacctctgttgctgcccgaggtctagatgtgaaacatctgattcttgtagtaaattatagctgccccaaccattatgaggattatgtacacagagcagggcggactggaagagcaggaaacaagggttatgcttatacttttatcacagaggatcaagctcgctatgctggtgacataattaaagctcttgaattgtcagggactgcagtacctcctgatttagagaaactgtggagtgatttcaaagatcagcagaaagctgaggggaaaataattaaaaagagtagtgggttctctggtaagggattcaagtttgatgaaacagaacaagctttggctaatgagaggaagaagttacaaaaagcagctcttggtctacaagattcagatgatgaggatgctgcagttgatattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggtagatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaagaagagagacaggatggtggacagaatgaatcttttaagagatatgaagaagaattagagatcaatgacttcccacagactgctaggtggaaagttacctctaaggaagctctgcagagaatcagtgaatactctgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatgg

SEQ ID NO: 328 - DNA, 5255 bp, Homo sapiens
cgaccccagccaccgccctgcggccagcgcgtcccccgactcgccgcccggagaccccgaggctccaacgagttcagaaatgtccagaaatgacaaagaaccgttttttgtgaagtttttaaagtcttcagacaattccaaatgtttttttaaagctctcgagtccataaaagaattccaatcagaagaatatcttcagattattacagaagaagaggcattgaagataaaggagaatgatagatcactttatatctgcgacccttttagtggcgttgtctttgatcacctcaaaaagcttggctgcagaattgttggtcctcaagtagtcatattttgtatgcaccaccagcgatgtgtcccaagagccgaacatccagtttataatatggttatgtctgatgtaaccatatcttgtacaagtctggaaaaagaaaaaagggaagaagttcataaatatgtacaaatgatgggcggacgagtatacagagaccttaatgtatcagtaactcaccttattgcaggagaagttggtagcaaaaaatatttagttgctgcaaacctgaagaaacctattttgcttccctcttggataaaaacactttgggagaagtcacaagagaaaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgatagtcgtactctttcagatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcggatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggcctcatgtagtgggagcaaagtggttgctagagtgtttcagtaaaggttatatgctttctgaagaaccatatatccatgctaattaccagccagtggaaattccagtttcacatcagcctgaaagtaaagcagctcttttaaaaaagaagaacagcagcttctctaagaaagactttgctcctagtgaaaagcatgagcaagctgatgaagatctgctctctcaatatgaaaatggtagctccacagtagttgaggctaagacgtctgaagccaggccctttaatgattctactcatgctgagcccttgaatgattctactcacatttctttgcaagaagaaaaccagtcttctgtcagtcattgtgtccctgatgtttctacaattactgaagaaggcttatttagccaaaagagtttccttgttttgggttttagtaatgaaaatgaatctaacatcgcaaacatcataaaagaaaatgctgggaaaatcatgtcccttctgagcagaactgttgcggattatgctgtggttcctctgctggggtgtgaagtggaagccactgtgggagaagttgttacaaatacatggctggttacttgcatagactatcagactttgtttgatccaaagtcgaatcctctcttcacaccagttccagtaatgacaggaatgactcctttagaggattgtgttatttcatttagccagtgtgctggagcagaaaaagagtctttaacattcctagcaaacctccttggagcaagtgttcaagaatactttgttcgcaaatccaatgcaaagaaaggcatgtttgccagtactcatcttatactgaaagaacgtggtggctctaaatatgaagctgcaaagaagtggaatttacctgccgttactatagcttggctgttggagactgctagaacgggaaagagagcagacgaaagccattttctgattgaaaattcaactaaagaagaacgaagtttggaaacagaaataacaaatggaatcaatctaaattcagatactgcagagcatcctggcacacgcctgcaaactcacagaaaaaccgtcgttacacctttagatatgaaccgctttcagagtaaagctttccgtgctgtggtctcacaacatgccagacaggtcgcagcctccccagcagtaggacaaccacttcagaaggagccctcgttacacctggatacaccatcaaaattcctgtccaaggacaaactcttcaagccttcctttgatgtgaaggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggaagaagccccaaagccacttcacaaagtagtggtatgtgttagtaaaaaactcagtaagaagcagagtgaactaaatgggatcgcagcctctctaggagcagattacaggtggagttttgatgaaacagtgactcatttcatctatcaagggcggccaaatgacactaatcgggagtataaatctgtaaaagaaagaggagtacacattgtttccgagcactggcttttagattgtgcccaagagtgtaaacatcttcctgaatctctttatccacatacttataatcccaaaatgagcttggatatcagcgcagtgcaagatggccggctctgtaatagtcgactactctcagctgtgtcttcaacaaaggatgatgagccagatcctttgattttagaagaaaatgatgtagacaatatggccaccaataataaagagtcagcaccatcaaatggaagtggaaagaatgactctaaaggagttctgacacagaccttagagatgagagagaactttcagaagcagttacaggagataatgtctgcaacatcaatagtgaaaccccaagggcagaggacttccctttcaagaagtggttgtaacagcgcatcttcaacccctgacagcactcgctctgctcgcagtggacgaagtagagtcctagaggcactgaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacaggctgtctgtgatcctggaaacatacgtgtgactgaagctcccaaacacccaatctctgaagaactggaaactcccataaaagacagccacctgatccctacgcctcaagcccccagtattgcctttccactcgccaacccccctgtggctccgcaccctagagaaaagattataacgatagaggagactcatgaagaattaaaaaaacagtacatatttcagttatcatctctgaatcctcaagaacgtattgactattgtcatctgattgagaaactaggtggattggtgatagaaaagcagtgctttgatcccacctgtacacacattgttgtgggacatccacttcgaaacgagaagtatttagcctcagtggcagctgggaagtgggtgcttcatcgctcctaccttgaagcctgcaggactgctggacacttcgtgcaggaagaagactatgaatggggaagtagttccatacttgatgttttgactggaatcaatgtacagcaacgaagactagcacttgcagcaatgagatggagaaaaaaaatccagcaaagacaagaatctggcattgttgagggagcatttagtgggtggaaggttattttacatgtggatcagtctcgagaagcaggcttcaaacgccttcttcagtcaggaggagcaaaggtgctacctggtcattctgtacctttatttaaagaggccacacatcttttttctgacttgaataaactgaaaccagatgactcgggagttaatatagcagaagctgctgcccagaacgtgtactgcttgagaacagaatacattgctgattatctcatgcaggaatcacctcctcatgtagaaaattactgtctaccagaagctatttcatttattcagaataataaggaacttgggactggattatcacaaaagaggaaagctcctacagaaaaaaataaaatcaaacgacctagagtacactaatcgcatctaccctttagttaccaaacattaaatgtttttaaaaattgaaagcctgaatgtgactgtgatagatttgggtagtaatttaaagatgagtacctgaagaattctgcttcagagtataatgatgacccttcttgagttttgaacacctgaaattgtaatcactgaaatattaactgtttcttaataaaaagttacctgaaataacaacaaaatacaactcctcagctagcttgctgttaaaccacattgaagtctgttaaaagatatttatttttcttgtaaatatctgaagctgtagcttagtggaaattttagcaaggtaatggattttgctttaaaatgtctgccttacaaattcataacaacaagatttgtcagtcagcatttattcatgttttccctgatttttatcttctcaccattttacctcttttaacaggagcctgagcacaaggtttaatgaggaagctggggctataaatatgtgtgtatatatgtatatgtatgtttgtacaaatctccatgatgtttgccaagtttgaatgcgcaaaacttggaaaatgtgacaataaagaataaaagtagtaactcaaattagtat

SEQ ID NO: 329 - DNA, 736 bp, Homo sapiens
cgagctggagaggtggtcggagaagtaggaacctcctgccgggctcgtggcggcttctgtccgctccgcggagggaagcgccttccccacaggacatcaatgcaagcttgaataagaaaaacaaattcttcctcctaagccatggcatatcagttatacagaaatactactttgggaaacagtcttcaggagagcctagatgagctcatacagtctcaacagatcaccccccaacttgcccttcaagttctacttcagtttgataaggctataaatgcagcactggctcagagggtcaggaacagagtcaatttcaggggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacttttttttaaggacaaaagttgttgccttcctaagaaccttctttaataaactcattttaaaactctg

SEQ ID NO: 330 - DNA, 2162 bp, Homo sapiens
  modified_base (909)..(909): a, c, g, or t
  modified_base (1400)..(1400): a, c, g, or t
  modified_base (2051)..(2053): a, c, g, or t
  modified_base (2056)..(2056): a, c, g, or t
  modified_base (2072)..(2074): a, c, g, or t
ttttttttttttttttttttttttttttttttttttttttttttttttttttttttttttttttttttttttttttttttttttttttttttttttttttttttttttttttttttttttttttttttttttgtgtttcaacaaactttatttatgaacactaaatattcatgttaattttcaagtatcataaaagtctttaaaaaaaaacatttaaaattataaacacaattcctagctcacaggccataaaaagcaggcagcaggctggatttgatccacaggccatagttggctgtctcttaaacaggcttttatacgttatgcaaagtgtttcaaattccagagactttggagacttttcgttttttagatttctcattttaaaacacacataatacaagttttctttctggatcaatatactcacgagagaaaataattcagaaaaaaataaaattccttacttaaaaaaagggaaaagctatagaacaaatgtttcgtcttaaaatatatttaggaaatgtaaaattaaagattaaaaattttattctatgcaacataaaataatatgcataaatctggcacataatttctttgtttttactttagaaaaaagacagtaagaaaaaagtttataaatttctcagtcccttttatacaaagttgcaactaaaaccagcaatcacttatatgtacaaccatcaactctgaatacaatgtgaattatacctaggaactgtaatttacctagatgagttctgcctgctttatgaaaaacacacacttatatcacagaacaccgtggcttctacaatttgtaacaattttgaaaacgaaactcctgcctccataatataaggaaacaagagtactctttccatagtcatcatcctgtataaaaaaaanttcatagtctgatttacctttgtcaaaggtaaaatgattcacatttgcttggattactctgatcctcagtagttcctaaacacaaaataaagtttgcatgaacctttatctgggttttccaaagcaagtattatgctggcagaagtccatgagctgaataaaaagatactaaatataaaaggtttaccaactttatcctttcttaattttacgatagcttcaggtattgagacctaactggtttcctgtgcctatccattgtgaacacatctcaatcttctacttttaacactcctcagcaccatattttcgttgtttctttattgtgcgacgtagaagatcctttcgtccaacttcaatcatttgttcttcccaagacttcatttcattatgataacgagtttcgtcctctttagcatgctgaatatataattccttttcagagtcagacagatttttccagttttcctttacagtcttcagcttttccntgcggtgaatcacccttagcttcttggaatctttcagctacataaacgttataagctgaacgaggtctttttggttttccaagcagtgttaactcttttttttttgtcatagctttcctttttaaatgtttgtccatgatttctttttccaaagacataatctgacttggagttagctgttctttaaatctgcttatctcttctttatatacctgccactccgccctataagcatcttgatatatttttttctttgaatcaggaagttccctccaacgctgggcaattcttctaattagttctgtagtttttgcatctgggttctgagctttaaatatgggtagttgttctttagaaaatcgaaggtaagaacttacaggtttctttggacaacttgccaagacagatgaaaaccacctcggtaaatacacaaaactgaagggggagcgcagtcgacttccacagccggtgcacagctctgctccagaccttcccagggcactcagcacgccccacatgcttcggagaaacgccatcgctccggtggatgaggcagtgacccgaccccaatctcggagagcctcctggcaatacacaactccagcaatcacaactggaacccgcgtgcgaccctccggcgtgtgttatcannnccnccactagcgaggcacnnngggaaatctgctaacatccggtcggtagatggggacggggcggggcggaattgcgcaggcgcgggagagcgtaccccggtgggcggcc

SEQ ID NO: 331 - DNA, 2672 bp, Homo sapiens
  modified_base (14)..(21): a, c, g, or t
  modified_base (409)..(409): a, c, g, or t
  modified_base (437)..(437): a, c, g, or t
  modified_base (457)..(457): a, c, g, or t
  modified_base (513)..(513): a, c, g, or t
  modified_base (524)..(524): a, c, g, or t
  modified_base (2659)..(2660): a, c, g, or t
  modified_base (2668)..(2670): a, c, g, or t
tttttttttttttnnnnnnnngcaatttacaggctcaatatatttttttacactttgcttgaaagaaaatttcaatattttacagtctttcagtaggcattatatacactgcactttatgaaatctaaaaggtattgaaataaatttttccaacattttggtaacaaaacaaacaacgtttctccaaatacttgtgctatctacatgatgtttgctctgataatcactaatcaaaacaaacaacgtttctccaaatacttgtgctatctacatgatgtttgctctgataatcactaatcacaaaaaactgactcaatggaataattagaaaaattgtctaacaccatgcatgggtttcaatcatttttaatatcctatcctagaaacattctacaaatcttaagatttnaaaaattaagtctctgttctgatttttnaaagatacctttttatgacnatatccataacattgacaggtacatgttaaggctagtatcatccccttttttgaanttttttgactntttttttttttttttaagaaagatagtaaaagccagactccctttagggctttgaactgtacctacagaaaatcagagtgcagtgaacataatgttcagtcctacagtcaggatgcagttgctccttcccattccacaagatactgcacctttccatcaagtgtcacccgacgtgccaaaactcggtatttttcgccacatgctattctacctgcagcaccaaaataactggtaatggagttctttagatgattgagttgtaactcctgatctgctaagttattcagaatctctgtgttgagttcatcaaactgataatcttctttgccttcatcatcttttacaatttctgagttctgagtctggagtgctcttcttggaagacgacctcttcttctccgcaaatgtggtattgcagcaggccaagatcttcctgtacgcgttctttttctggagtcagataatccataatgcctggaaatgctagacgaggtagtttcttttgcactggaagcacccgtgaaatccacatctgaggtattggatgaatgtgcagttccctcagttctccctatagaacaaggtaaatccaaagtaggattctctgaaattgattccttatccaaaagtggctcagcagttttttgaatcatttttcttgtatatgggccaggtggacgacctacagattttttctttccttttttttctatgccattgcttacttcccttgaatcagatataggtttggatgcctttctgcctttaattttaaattcatgagatgttccttcaggttctttctctgctttgaaagccacatttggtggcacaggaggaacacgaattcgcaacccaaacaaatgcttcttcttctttatttctttcccagacataaacatggtcttgtaatcatttaatgcctccagaacatgctcatatctttcagattttggtgtgtctgccagctctccagggtgcaatctatcccagttttcattaatgtatgtcataagctcaagttcagaatcaaagtatttcttcttatgaataacacttaggttgtaaaggcataggtgtgctatatctacccactgtaatggtagacgtttgaggtattctggtccagaactgcagacagagcatataaacgtataaaatctgtctccaaatagcattggcttttgaaggcattgcacacaagcctcatgaaaccactgcttacatttgcagcactgtagcatcttcaaataccagtctccagggcctccacaatagcagtaacactgctggacattggttttatgacctgcatcccattcaaggtctgccacactatagggtaatgtctgcttcatgacttgcaatgctttggcatttggtcctttcttaagtgcaccacccctctttgttgttgttgcaaaaacacactgccgacagagccatttttcatctgaatcaatcacactggaatcaatatgaggtgtgtgacacaactgatgatatccttggccacacttgtcacatataaccatttcattgggagcttctgaatactcttcttgacatattgtacagaccatttccccacttccagtggctcctgcctgtttgaatgtccttccagagaacccaggatttagaactgtcttcaaatatgatgaagcagctctgtttcaatatgtttatctttttgatagtgccaagataaaacaagccatctgaccatctagctaggacatcctgaccctcttcaaatttacatgctggctttttggctttatgtccatcctgtaaagacagcttggtcaaggatgttggggtcttttggtttcgacgtaaaggagaccgcttgtggaccagtgaattacctgcccctgtagagtctctcattcggtcacttcagtggtgccaaccgcttcatacaggaaaaaacaaccaatccgtccccgtgggcgcttcccctgcgagtccgagcacttactgggcacccgccccaccgggtacccggcacatatgcacgcacaaaccgaggtccttggagacaagggttgggggtagaatgagcgttcttacaccggcctcaaacacagcccacttcaatacagcccctcgccattttggtttcccgcggnntgccgtcnnngc

SEQ ID NO: 332 - DNA, 647 bp, Homo sapiens
gggcgccgccatcgccgtcatgctgggcgccgctctccgccgctgcgctgtggccgcaaccacccgggccgaccctcgaggcctcctgcactccgcccggacccccggccccgccgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtctagttcgaatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttattttgaacaagtttccctttattgagtaccaagccatgtaatggtaacttggactttaataaaagggaaatgagtttgaactg

SEQ ID NO: 333 - DNA, 622 bp, Homo sapiens
ggcacgagctcgtgccggccttcagttgtttcgggacgcgccgagcttcgccgctcttccagcggctccgctgccagagctagcccgagcccggttctggggcgaaaatgcctgcccttcacatcgaagatttgccagagaaggaaaaactgaaaatggaagttgagcagcttcgcaaagaagtgaagttgcagagacaacaagtgtctaaatgttctgaagaaataaagaactatattgaagaacgttctggagaggatcctctagtaaagggaattccagaagacaagaacccctttaaagaaaaaggcagctgtgttatttcataaataacttgggagaaactgcatcctaagtggaagaactagtttgttttagttttcccagataaaaccaacatgctttttaaggaaggaagaatgaaattaaaaggagactttcttaagcaccatatagatagggttatgtataaaagcatatgtgctactcatctttgctcactatgcagtcttttttaagagagcagagagtatcagatgtacaattatggaaataagaacattacttgagcatgacacttctttcagtatattgcttgatgcttcaaataaagttttgtctt

SEQ ID NO: 334 - DNA, 2707 bp, Homo sapiens
ggcaggccgagccagccgtgcgccgcgctccagggcccagggcgccgcacacgcacccacccacccacccagcctcgcagcgccatgggcaagaacaagcagccacgcggccagcagaggcaggggggcccgccggccgcggacgccgctgggcccgacgacatggagccgaagaagggcacgggggcccccaaggagtgcggggaggaggagccccggacctgctgcggctgccggttcccgctgctgctcgccctgctgcagctggccctgggcatcgccgtgaccgtggtgggcttcctcatggcgagcatcagctcctccctgctagtcagggacactccattttgggctgggatcattgtctgcttagtggcctatcttggcttgtttatgctttgtgtctcatatcaggttgacgaacggacatgtattcaattttctatgaaactgttatactttctgctgagtgccctgggcctgacggtctgtgtgctggccgtggcctttgccgcccaccactattcgcagctcacacagtttacctgtgagaccacactcgactcttgccagtgcaaactgccctcctcggagccgctcagcaggacctttgtttaccgggatgtgacggactgtaccagcgtcactggcactttcaaactgttcttactcatccagatgattcttaatttggtctgcggccttgtgtgcttgttggcctgctttgtgatgtggaaacataggtaccaggtcttctatgtgggtgtcaggatatgctccctcacggcttccgaaggcccccagcaaaagatctaacattcttgctcaaagttgcgagagaaagtagcacatggagtagctgaggttaaacaaacaaaaaaaaattttaaacaaagaaaggaaaaaaattgacaataaaagtcactcttctaattgaatatttttatatttttatgaaacaaaagagcatttcttcaggtttctattgtattttttttaacattcttgcagagaaagcaagatccaaattgattttgggatattaaaagttaacagaacactgaacaaggaaagaatggcatagatctatctttacagtctggagttaattcctgttaactcattttatccattccttacataatcttctttcctgttagtccagtttgatggtgtgaatggtgaatttcaggcccagttgctaaattttgtggcatcttcctctagtccttcccacctccagtcatcagccccactctgtcttggagacaggcaggaggtgggggaagagctgaatctctttattttccctggtagagacatcttcaaggcatgaaatagcttaaagagcagagtagaaatggaagaggctttgcaaaaggctagataactaacaacacctgggttggggcggcggcctcttctcttcagctcccttagcttggctccgtaagtggatcacttgccaaatgctttagatgattgcctctcaataattgaaaggtggtggtagttgtattctaaatgatgtagaaggtttaaaaataattacattatgcttctattctatcatctaaaacaaatcattaaaactaatttctagctaattgttaattataattatgctcagaagtctatttaatgagctctgactgtacttacgctgcactgtcggtgttaagagaaattactctcacaagagcagaggcctgaagattctttcttctgaaagccaagcaccacaaggaaaaaaaaattattaatagctcaggttaaaaacacccatttaaacaaaaacaagagcatttgtaataggaagtgtttatacaaacagcacatttgtgatatgttgaaaagcatctctcttggcaaccaatctatgtttgaggaagattgggtaatgctgatgtgttccattcatgaaactgtatttgatacataatcctattattaattcgtatgcttagtcaacctaggaaatcaaaataatgttttgaagttcttatttgagcaatatggccttgacttggagggtagttttagttgttttgtttttaagtgactgtggtttaaagcacaaatgccccaaggtggggagacttctctctgtgattattgttgctattaaattctgaactgtatccatattttaaggaaggagctaaaaatggaaattcatgaaacataaatggtatcaagaactttatcagtatgctttgttgaaagcagaaattaagataataattgagttcaattcgcctctccgcattgcctattgatacactttactaatcatgaaattctaacctaaaaggaaaacattttcctgcttgtcttagaagaaagtggaataattccactgattgtgataatggtttcaatttctacacaatataaatatccagtataaaggaaagcgttaagtcggtaagctagaggattgtaaatatcttttatgtcctctagataaaacacccgattaacagatgttaaaccttttaatgttttgatttgctttaaaaatggccttcctacacattagctccagctaaaaagacacattggagagcttagaggataagtctctggagcagaatttatcacacacaaaagttacaccaacagaataccaagcagaatgatgaggacctgtaaaataccttgtgccctattaaaaaaaaaaaaaaaaaaaaaaaaaaaaaaaaaa

SEQ ID NO: 335 - DNA, 917 bp, Homo sapiens
aggaggcagtagttccccgcttcccttccgcgggagggagagttagctagccatccaagaaaacaccatgaaagataacgatatcaagagactactgtatacccatcttttatgcatattttcaattatcctaagtgtcttcattccatcactcttcttggagaacttctcaatattggaaacacacttgacatggttgtgcatctgttctggttttgtaactgctgtcaatctagtactatatttagtagtgaaaccaaatacatcctctaaaagaagttcattatcacacaaggtaactggatttttgaaatgctgtatctactttcttatgtcttgtttctcctttcatgtaatttttgttctgtatggagcaccactgatagagttggcattggaaacatttttatttgcagttattttgtctacttttactactgtgccttgcttatgtttgttaggaccaaacctcaaagcatggctaagagtgttcagtagaaatggagttacatccatatgggagaatagtctccagatcactacaatttctagctttgtaggagcatggcttggagcacttcctattccactggattgggaaagaccatggcaggtatggcccatctcctgtacgcttggagcgacctttggctacgtggctggccttgttatttcaccactctggatatactggaatagaaagcaacttacatacaagaacaattaactggagcaaagggagatatttctttgtgcagattctgtaagggctgggcagaaatgtgtatggtcaaagccaagcagttccatttacagctctgttttttacgtagttacaacatgatgtgattgtagctttttaaactatgaaacccctgagagattgtaccttctagttgaaataaagtatttataat

SEQ ID NO: 336 - DNA, 7639 bp, Homo sapiens
  modified_base (3159)..(3159): a, c, g, or t
  modified_base (3439)..(3439): a, c, g, or t
  modified_base (3933)..(3934): a, c, g, or t
  modified_base (4633)..(4633): a, c, g, or t
  modified_base (4946)..(4946): a, c, g, or t
  modified_base (5191)..(5191): a, c, g, or t
  modified_base (5265)..(5265): a, c, g, or t
gggccttgcgccgcgggagcggacggcggcggaggagaccctaggctcgcggcccgaggcgggagggctcggcttctcgactgcccgcctccgaggccgccggccgcttctctctcccagagtggccgccgcccctggagactcgccgtgacacgggcctaagccgccgccgcgggagtcctgaccgctcggacccgtcggatcaggccgggtgggagcgagcttgcgggcaggtgccgctcccggagggtgggccggaggcgaggcgcccaccgcgcggctcgcgggccgggctcggcggaggggccgctcgcgcagcacccccaccgcgggccggagcccgggtcgccgccccgccttctcccgggaccgcccggccggagctgcgggggccgagggacgccgcgcccgccgccgccagccgggctcgcgcgggagagcagggaagagaaactttgccttttattgtttttagtccttaagtgcaaggaactctgtgttgggaggaaaaatgtccttcttcagtttccgtaagatcttcaagttggggagcgagaagaagaagaagcagtacgaacacgtgaagagggacctgaaccccgaagacttttgggagattataggagaactgggcgacggagcctttgggaaagtgtacaaggcccagaataaagagaccagtgttttagctgctgcaaaagtgattgacactaaatctgaagaagaacttgaagattacatggtagagattgacatattagcatcttgtgatcacccaaatatagtcaagcttctagatgccttctattatgagaacaatctttggatcctcattgaattttgtgcaggtggagcagtagatgctgtgatgcttgaacttgagagaccattaactgagtcccaaatacaagtagtttgcaagcagactttagatgcattgaactacttacatgataataagatcatccacagagatctgaaggctggcaacattctctttaccttagatggagatatcaaattggcggattttggagtatcagctaaaaacacgaggacaattcaaagaagagattcctttattggtacaccatattggatggctcctgaagtagtcatgtgtgaaacatctaaggacagaccctatgactacaaagctgatgtttggtccctgggtatcactttaatagaaatggctgagatagaaccacctcatcatgaattaaatccaatgcgagtgctgctaaaaatagcaaaatctgagccacctacattagcacagccatccagatggtcttcaaattttaaggactttctaaagaaatgcttagaaaagaatgtggatgccaggtggactacatctcagctgctgcagcatccctttgttactgttgattccaacaaacccatccgagaattgattgcagaggcgaaggctgaagtaacagaagaagttgaagatggcaaagaggaagatgaagaggaggaaacagaaaattctctgccaatacctgcaagtaagcgtgcatcttctgaccttagtatcgccagctctgaagaagataaactttcacaaaatgcttgtattttggagtctgtctcagaaaaaacagaacgtagtaactctgaagataaactcaacagcaaaattcttaatgaaaaacccaccactgatgaacctgaaaaggctgtggaggatattaatgaacatattaccgatgctcagttagaagcaatgactgaactccatgacagaacagcagtaatcaaggagaatgaaagagagaagaggcccaagcttgaaaatctgcctgacacagaagaccaagaaactgtggacattaattcagtcagtgaaggaaaagagaataatataatgataaccttagaaacaaatattgaacataatctaaaatctgaggaagaaaaggatcaggaaaagcaacagatgtttgaaaataagcttataaaatctgaagaaattaaagatactattttgcaaacagtagatttagtttctcaagagactggagaaaaagaggcaaatattcaggcagttgatagtgaagttgggcttacaaaggaagacacccaagagaaattgggggaagacgacaaaactcaaaaagatgtgatcagcaatacaagtgatgtgataggaacatgtgaggcagcagatgtggctcagaaagtggatgaagacagtgctgaggatacgcagagtaatgatgggaaagaagtggtcgaagtaggccagaaattaattaataagcccatggtgggtcctgaggctggtggtactaaggaagttcctattaaagaaatagttgaaatgaatgaaatagaagaaggtaaaaataaggaacaagcaataaacagttcagagaacataatggacatcaatgaggaaccaggaacaactgaaggtgaagaaatcactgagtcaagtagcactgaagaaatggaggtcagaagtgtggtggctgatactgaccaaaaggctttaggaagtgaagttcaggatgcttctaaagtcactactcagatagataaagagaaaaaagaaattccagtgtcaattaaaaaagagcctgaagttactgtagtttcacagcccactgaacctcagcctgttctaatacccagtattaatatcaactctgacagtggagaaaataaagaagaaataggttctttatcaaaaactgaaactattctgccaccagaatctgagaatccaaaggaaaatgataatgattcaggcactggttccactgctgatactagcagtattgacttgaatttatccatctctagctttctaagtaaaactaaagacagtggatcgatatctttacaagaaacaagaagacaaaagaaaacattgaagaaaacacgcaaatttattgttgatggtgtagaagtgagtgtaacaacatcaaagatagttacagatagtgattccaaaactgaagaattgcggtttcttagacgtcaggaacttcgggaattaagatttcttcagaaagaagagcaaagagcccaacaacagctcaatagcaaactacagcaacaacgagaacaaattttccggcgctttgagcaggaaatgatgagtaaaaagcgacaatatgaccaggaaattgagaatctagaaanacagcagaaacagactatcgaacgcctggaacaagagcacacaaatcgcttgcgagatgaagccaaacgcatcaaaggagaacaagagaaagagttgtccaaatttcagaatatgctgaagaaccgaaagaaggaggaacaagagtttgttcagaaacaacagcaagaattagatggctctctgaaaaagatcatccagcagcagaaggcagagttagctaatattgagagagagtgcctgaataacaagcaacagctcatgagagctcgagaagctgcnatttgggagctcgaagaacgacacttacaagaaaaacaccagctgctcaaacagcagcttaaagatcagtatttcatgcaaagacatcagctacttaagcgccacgagaaggaaacagagcaaatgcagcgttacaatcaaagacttattgaggaattgaaaaacagacagactcaagaaagagcaagactgcccaagattcagcgcagtgaagccaagactcgaatggccatgtttaagaagagtttgagaattaactcaacagccacaccagatcaggaccgtgataaaattaaacagtttgctgcacaagaagaaaagaggcagaaaaatgagagaatggctcagcatcagaaacatgagaatcaaatgcgagatcttcagttgcagtgtgaagccaatgtccgcgaactgcatcagctgcagaatgaaaaatgccacttgttggttgagcatgagactcagaaactgaaggagttagatgaggaacatanncaagaattaaaggagtggagagagaaattgagacctaggaaaaagacactggaagaagagtttgccaggaaactacaggaacaggaagtattctttaaaatgactggggagtctgaatgccttaacccatcaacacagagccggatttccaaattttatcctattcccagcttgcattccaccggatcataacaaagggaagcattctgtgcgtgggtttggctctttcagtatgtcattctgttctcatcttctgccacagtctctcagatagctcatgaagacaatcacctgcctcaccttctaggtgttttccttttttgttttttttgttttgttttgtttttaagcaaagatgaagggaaaacgaactaagacagacgctaggccatgttggcaaagtagcatcttggtgactaaggtgactttgtatattcatcttaaaaattatgttctttagacactgctacctgaaaactgttggagaaataatgtttaaagttatttaagaaaaactgttacatcactaagtattaataaattcttcttacctgacgtaacttctcaatgcctaaattctgtagttgaagctctgctgcagagagttgggataattttcttttggtggatcagctctcataaaaaagctatgatttgctcaaatatgctgttgactcagtaaatgaatatatttttttntttaaataggaacaacctcttttaaaagagaaaaattatttcagtgatttgtcaaaacgaattacctcttttggcatgagctaataattgagggtgctaattttcttaagatagtgcctaaaacactaaatttcagtcaagtcgtaagtaggattttctttttgatcaacagggacaaaaacatctttagaattaaaaacatggttgttttggaatttttgcttctcttaccgtttgatagaaattttcatcctaaaatacatgtacaaagtttggaaagatgaaaaaaagaggtagcttttagattgcaaantggaaatgtaaaactcatgaaatttaagcaatataggtttagctatctgtgtttattttctaaaataatacctgagctggttaaatgatttctctccatcttagctaattctgtttaaaactctgtcagaggcctgcaggctgtgagttatatttataaatatatcttcagaaattaatcttaaaagaggcattagttcagaatacttttttaaaagtttaaattaaatatttaggcacgtcagnaattacttttccttattttgaaatgaggctacttatgtcttggttttattttgttccatgtttaaatcattcantttgatttgagtgggaaaagcctgaagcctttatcatgtggttgctggtgtgtgtaattattaatgaaatgttcactcctagtcccttatgaggcttagaatttcaaccacgtgtcaggtcagacagtattataaactgtactttgctgtctgagacagcacatttgtgaatgatgcttgctgcctgccattttcaacctattctctcttaagagtgctaggtaccaaattgtgaaagtttgttttcagttatattacttttgaggctggtgaaaaatttaaatgtaactttgtgggaacactgattcatatttagaaaatgtaaatgtctgtagcactttcttgcagttaatttgaaaactttggatgctgaaccttgtttgtcagtgatttagatgatttaaaaatgcatgtgtgatttgaattttataattgttttgacaagcataatttacttggacaacttcgtaggtagccttaacttctggccaagtttgttttttatataaatatatatacatatatacatattatgtatggttgtaaattcatacacttatcacatgaatgtgttactgtatacaaaactcttaatgctttattctcaaatgctgggttgaaaaatgttttgaaagccttttaaaatatatatctttataaagtaatattcaggatgatgataaaaattgtttatattgttatgataaaaatgacagtataatgttgcccagtgtatttaatgatttatttgaagagggattgggaaggaacgtcttcataccactttctcctttgaaattttcagtttattgacttttaaaaaatgaatacctcaggcagtagacattttttttctagtatcatttaattgataccctgtgcgctaaatagtgtgtggtgcctgattaatttggtctgaatatttgattctttctgttcctttcaacttgacattcagattattgactcaaggagagaggctcagagtggaatggttggcgctgtgggtaaggttggatctcccttaaaactgccttttggattcagtgtttgtgcttgagttcgctttcaaatatgaccataatcgtgtgggtgcaagactgtacagtgatacatatgtagaggtaaagcattcattttaatacttaaagttatataaatcttttcaaaaagtgttttgttataaaatacgctgtttgtacccataccagcccacctcttctgaggccctgtattcaaatagatgatagtgatctatctttcctgcatgaagtgtaggtggcgagtgggcgaggggcgcagacttctttgaaatcgaagggtacagtcaaatctactgctgatttggttgttttgttgctgtggcagaatatgccatgaaacacatacagacttctccgaacgtgcaccctcatcagccacctcctcccctctttccctgagtgctgtgaacacagcagacctgcacacttctgcagatccagctcctacagcttggggcactaggctgcctttcctagtcctgtcaacaaccatacagtgcgaattgctgaattagctgctattctatgtggagtcacattaagctttttcttatctttttctatggggaagctatagggtgggtaaggaaaaaatgttgaatgcttttactttgctgaaaatattagaactctcttgtgacaggatacagcaaattataattaaatataaattaccagaaccagagctacctctaagtcatacttcctcaagcacaaagctctcaggcatatgagacccaccttaatgaagggtctctgatttcttgagcatcagcgagtttcagaagtgactatttttttgtactcttctagtttccttgtaactatacactttttcccattccacactgtgcttaaatgacaaagactcttctgagaagccaaattctgtccaagtattaactagagatattgttgattaaagaaaatctagaactgaagtgaaagaagagagttccagttctaatagtcttttgattaacaattcttttctgagaaatgatttttataagaaatggggtgattctttaaatgcttttcttaagttgaaggcacaacagttaatggctgtattgttgctattccgttgctgacatgtttttgataaagctttaacattcctgctactaattttggcggagagtgtttgccaggtttcaatgtgggctgcagctttttgtgctccttctctggtttgcagtgtaatgagttcataagctaaattttcagaaagaattttgtttaagattatgcctcttatctacttgagagcaacatgtcttttcaatcatgggattgacacatgaaaaataaagttatttcttaatcaa

SEQ ID NO: 337 - DNA, 1552 bp, Homo sapiens
ggcacgaggagaggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgtaaaaaaaaaaaaaaaaaaaaaaaaaaaaaaaaaaaaaaaaaaa

SEQ ID NO: 338 - DNA, 5985 bp, Homo sapiens
  modified_base (321)..(321): a, c, g, or t
  modified_base (1124)..(1124): a, c, g, or t
  modified_base (1128)..(1128): a, c, g, or t
  modified_base (1134)..(1134): a, c, g, or t
  modified_base (2260)..(2261): a, c, g, or t
  modified_base (2264)..(2264): a, c, g, or t
  modified_base (2266)..(2277): a, c, g, or t
  modified_base (2768)..(2771): a, c, g, or t
  modified_base (2934)..(2934): a, c, g, or t
  modified_base (3042)..(3042): a, c, g, or t
  modified_base (3122)..(3122): a, c, g, or t
  modified_base (3233)..(3234): a, c, g, or t
  modified_base (3695)..(3695): a, c, g, or t
  modified_base (4080)..(4094): a, c, g, or t
  modified_base (4097)..(4097): a, c, g, or t
  modified_base (4100)..(4100): a, c, g, or t
  modified_base (4132)..(4133): a, c, g, or t
  modified_base (4137)..(4138): a, c, g, or t
  modified_base (4140)..(4143): a, c, g, or t
  modified_base (4146)..(4158): a, c, g, or t
  modified_base (4241)..(4241): a, c, g, or t
  modified_base (4320)..(4320): a, c, g, or t
  modified_base (4582)..(4582): a, c, g, or t
  modified_base (4772)..(4772): a, c, g, or t
  modified_base (4794)..(4794): a, c, g, or t
  modified_base (4853)..(4853): a, c, g, or t
  modified_base (4876)..(4876): a, c, g, or t
  modified_base (4912)..(4912): a, c, g, or t
  modified_base (5379)..(5380): a, c, g, or t
  modified_base (5486)..(5486): a, c, g, or t
gacagcggaggatggaagcgagaccggggctggaggcgggccgaggccgcgagttgagcctcaggaagcagaaggggcgcggaaagatgcgattgacgtcgcaagcgaaccaatgacgagcgagctgtggcaggcctccagccaatgggcagtgaggcctgacgcggggggcggacgctggggccgagggtagcttgagcgcggcggcggcgttgttcagtcagagcgagaacattccagaggtcgcccagctccggcgctgacgggtgtggaccgcggacgtcgctgggacagcccctccccgctgctcggcggcggcanctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaanaaanaaaaanaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcnncanannnnnnnnnnnnaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgcaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaannnntaaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagttngttctgtaatgccttttacatttggacacatagtttatgctttttagattttggttgctttcttgccaaaataagtgttaactgtgtttcaaacttgattttctttcntttttcttttttttttcttccagaatgtcttatttaaaaagaaagctaaaagcatacttctaagtcagagcctctatttnggtgtaagacttgggatattttttacttcacattgaatatagccaggcacccaagaagtctgatggccacctgagtgcaggtgacaaggacctgacagagcccatgcaggnntttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttncttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtannnnnnnnnnnnnnnaanatnaaagttaacaagttttcattttataatgagannaaannannnnaannnnnnnnnnnnngtagccgttgctttggatttgtgttggatgtatcctgcagttacacttgccagccccactcacaaaagttgttcatttcattngggtcactggctttatttgctagtcttgtctgtgaactgagcatctgcctcagttttattacttgaaatcttggcaggngcttaatagggaacatacatacagctatgtaactgtgaataattgtatatatctctagttaagaatgagggaatggggaggtttgctttctaaacaagtgcattctgaaattgacttaaaaatttttagtgtgggtcctaaagtttagagatgggcaaggaggtctctaatccaccgcttcccgcttgagaagggaggggtatcaaaattgagccccaagctgtttgttccagtgtaccaagcactgactttatgcctttgncctggagatggcagaagtgaaagctggccatctgcaaaaagcagataagtgagtttgaaccttttgcattttgttagctcagtcagtcctcatcgtggtcctgaggcataggtactgttgtaccaaggtcacttatctaacaaaataacccttcatgtattttaaatttatttgacaagtctgcagacanatccttatctaaccagctattntcttaattgctacagcttgacctaccagtattccggagtaaccagcaaatgcaaagttnaccttgttcctgcatcatctttntgatggttcaaatttcagcctccctgactactacanagccagagcagtcttagtaccagaaacagtgttgcactttcgttgcatgtgctgtgtgaccccaaggggacagggagtcactttggtcatctctgtccccagtacagatcttgattcatagtgacattccataagtggggtgacagcaaatgacttgcaggtagtctcattgtaggtttgtgcaccagagtgaccctgtgagcctttgttaataggttgggagctcagggtgtttatgtccacctgtctggtctagccaaacagtttttttctgggaatcaaatttctgtggtttttatggccagaaattttaaggacttgtgtgtgctgggatatgagaatagaagctacagagttcttttcttgggacctagactgggaggtgcaatgtcaggacctccaggtgaatggtaggatctgagttgaccctgcagttcggttatgcagtcaattatttctttttaagnngaggaggattcacttgggtgttgggatcaaatttggattctgtcccaggccttactgtaaaactaggggattgcctttccatatctgctgggggtggagacccttntgtgcagcactcaatcccactggaagcctaatgctgcagtcagaagcaatgcctggctggggcagtaggggaaattccacccaattttgctatgagcctaaaacctctttaaaaacggtcagttaactaaaaaataaaaatcaagtctttaggagagtagaaaacacaattaactaaaaagcagggacatctgaaagagacgtattaagttaacatttttaaaaatccaaatgaaagtaaatggaataaatgtatcaggtaaaggacaagttgtaagcttggatttttaggtctagcaatacactgtttacaagagcatcacctaaaatgtgacaaaagatgttgaaaggatgaaaaaaggtatagtagacatacactaaccaaaaatgtagctctttgaatctcagaaaaaagtagattttaataaagtgtgaaagttgtcaatcaaaaaaaaaaaaaaaaaaaaaaaaaaaaaaaaaaaaaaaaaagggcggccgct

SEQ ID NO: 339 - DNA, 975 bp, Homo sapiens
cccaccaccagcgcagcagtcctggagctgacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaatggttaatggcagaaaaatcactacaaagagaattgtcgagaacggtcaagaaagagtagaagttgaagaagatggccagttaaagtccttaacaataaatggtaaggagcagctgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggacat

SEQ ID NO: 340 - DNA, 975 bp, Homo sapiens; identical to SEQ ID NO: 339

SEQ ID NO: 341 - DNA, 5964 bp, Homo sapiens
  modified_base (139)..(139): a, c, g, or t
  modified_base (141)..(141): a, c, g, or t
  modified_base (143)..(144): a, c, g, or t
  modified_base (148)..(150): a, c, g, or t
  modified_base (1137)..(1137): a, c, g, or t
  modified_base (1163)..(1163): a, c, g, or t
  modified_base (1704)..(1704): a, c, g, or t
  modified_base (1739)..(1739): a, c, g, or t
  modified_base (3369)..(3369): a, c, g, or t
  modified_base (3555)..(3555): a, c, g, or t
  modified_base (4354)..(4354): a, c, g, or t
  modified_base (5181)..(5181): a, c, g, or t
  modified_base (5207)..(5207): a, c, g, or t
  modified_base (5264)..(5264): a, c, g, or t
  modified_base (5358)..(5358): a, c, g, or t
  modified_base (5375)..(5375): a, c, g, or t
  modified_base (5461)..(5461): a, c, g, or t
  modified_base (5515)..(5515): a, c, g, or t
  modified_base (5563)..(5563): a, c, g, or t
  modified_base (5631)..(5631): a, c, g, or t
  modified_base (5825)..(5825): a, c, g, or t
  modified_base (5903)..(5911): a, c, g, or t
  modified_base (5914)..(5922): a, c, g, or t
  modified_base (5930)..(5934): a, c, g, or t
  modified_base (5936)..(5937): a, c, g, or t
  modified_base (5939)..(5940): a, c, g, or t
  modified_base (5950)..(5951): a, c, g, or t
  modified_base (5956)..(5958): a, c, g, or t
  modified_base (5960)..(5962): a, c, g, or t
tttggtttcattgtaaatacatatgatttattaaaaatataaactgatggtattctctataaattattccccaaacacattaaaagatgtgataatagatataaatttgcaaaccatttatagccaccctccccctttnantnntttnnntttttttttttttactgtaggtttatttttattcaaaaagttactgtctcaagacataaatacaaatcagaaaacagtacaattaggacaatagaatgtggaggacaacaggttagagtaatatataaaacatttttagctggttgaaaacaaagctgtaagaactgctttcacaaagaagtactcctttcaagagtgagaaaaaaaatcaacttaggtttaaaatcatatatacagtcctctcagcagttctagttaatgcagtggtgtgtaaaacaacataggcaatacttttgcacataacaatatttgttgatggaaaatctgttagacaagtctggattcatttgttattaaccatgacttaataaaataattgtatcatgatctttttagctaacctatggtttttggctaccacagcccaatgcttgatttctgactaaaaactgaaagccttttggtattcacccatctgaagatattcttgtattgcaagcatattaaggcatggaatgattaaaataatatacctcaagaactgagagacgactgacaatagatagatacacatgtaatataagttaatattttgttttaaacgatgtctagctgcctaagcctcgcaaaatgagttgatgtcaaaatggcaagtagccactttctgttttaaactaatttatttgtgaaaggacataaaatgaagtttaaagcttagctttcaaagaatattatgggttatgaattctattatcccatctaatttacatacagaggaaatgtactgtaacctgttagaagtatctttaacctgaagactgcttgcaaagacagatagataaaacaatataaaatacaaatttaaaaatcattttaaagcatgaacactcatgcttttctatttttaaacattgttaaactttcaatatatttctgaaacctcataattttaagttggaatttaaaagtaagaaaaaactaaacaanctgcgcaattataaaatcagcaccantttatatatatatataattttatttaaaatttagatccctattcccacactctaataagctgtataatttttgtttagaatttttctgcaaacatactacaataagcttcttttatttggagacaaaatacagtggcattactggaaggaatatcacaacattacatttttatcttaaaggacaagcaaactttcagggttgataatgggataagcatgtttgagactggttaccttctggcagttcactgcatctggatatttctgaaaagtatagagaagctcttggattttaaaaatatcttaaaatacttttagatgaaaaaattgtaaaagttctgcttataagtttacttttctccacaattacaatatttaaaacaaagttttgttgattgacgttttaagcatttaaatttagaatgctaaaaacaattctatcctacactttcttcagggtaggggaataaatacatccttaacattgttttctggatgtaaacagaaatccagcagaggtcatcattatttagtacaaccnagtaaataaatgtaagagaattcatatctgtaccnaatgcctcttcagattgttattttgttttttttttttttttaaaaaaaagcatgaaataatcgattcaaaagccaactaacagcgcataaataaaatatttactttctaagaaaaactgtagcttatcatcaaattgtttacttgtcctttacgtttattcaggcaaacaaaactgcccctcaatgcacttgatcttggtaagcataagcatgtcatattctccttagagaaaaatctgtacagaatttcactgtatctaccacactttaaaatttcctcttccacttagaaaatgacttcaccacagatttaattgtgtactggtattaaaacattgacactccaagaactgattcatccataattgaagctggatcaaagaaatcaggcttcagttctgttctctctcgtctgttctttgatggtggcaaatctatatccatggtgtcaaaatccattccctcattaagatcctcaatcctcccttctgaggacatcataacatcttccacaattggctcttcatcatcttccattaggcttgtgccacgccgattataatcaagaggtgtttgatgatgttcagtctgcattggataaacactcatgaagctatcctcaggccgtaatcttttgggctctctcataatagtggaggtgagttgtggtgtctgcatcataacaggggtgtgcagtgtttgttctctgcttaaccacatactgtcactactactactttcttcagtgagtgaaagctgcatgccctcaaccactttccgttttcctgtagatggttttgattttttactccgtactgttgacccccggctgctgattccactaatgactgacatggtgtcatcatcaccaccagctagcaaagaatttcggtaagacatcagtggaagccacacatcctctcttcggagtgacatctgaaaggtcatgaacttttccaagtaaacatacactgttcttttgtcttgtcgaagtagtttagaagaaaattcactcagaatatcaagaaatgccaaatttaaaggtggatggctctccccttgcggattaggctctttaaaagcaaattctatgccatctttgtgtagcatggcaatggcttctcttgttttcaactgatcaagtccaaaagttaaagcaaaacgtcgagcaagttcttttatgccactaaatgtagaggatgatctatcaaaattatagccattttcttgtatcatttcattaaaaagctgttgcagactgagaataagggtcttagcacactgaattttgtctatctgccttgttttactcattgtttctttgatgatatctccatagtcattataatacttcatatactgtttgaagatatctgcagctgtattcatctccaccacagtatatacaattagcttacaaaatgctgcaagtaaatttcttctcttgtgcagagcttcaattttactggcttcatcctcttgctgaccatctgcactattattatcatcatcctgttcaatgaagacatgatccaaaataaagctgagcaactcagactgcaatgaagaatcaggggtatacactaatggctctaacatgtcacgccctcctgacataatctgatggctngaagatcatcaaaatatcacacagaatagtgaaggcctgttccttaacagtagtattcacgttggtcaggtaatgttgacatatctgacaaaatactctcatttgtttctttaaacgcagcaagtcctcctttgtagagctgctttcagttatcttagcaagttgccaaaggattacatagtgagnacactgcagtgcgtgaataacaatctgctcaggcatgtctccattttcgattccagttttcaagagtttgtaattacaagcaaataaatcccactttgaaaggtcatgggcattatgaaaagcagtgatcctcttcaatgttgacaatacctgatatgcatcatcttcatcaggttcttcaccctcttgcagaaaatcttcaagaagccggttaaatttatctgccaattcatctatcagttgacttcttgaaatatctactctgttgaagattgtgaactcttcattacagagtgcatggtaagttttagaacatgcttccaaaacatctgtatctgtgtgcttctctacaatattccggatctgtcgcaataaggcatccaaatgcttttctaatcgtccagtggtatatatttccaaatcaaagtactgaggcaactgcaacaagttagtcaccttttctgcatctacagagtattttgctaataactgaggaagggccacggcaaaaagctcagtgatttttgtcctatcatccaactgtgtcttcttctcctttgctgtaagcaccctttttcctgtccctcttcccacgggaggatgacattcagccgcttgtctaatggtacaaagcattatttcaatcagagcactctcttgcctatctgttagtgcttcctctccactaagtggctcttccagtaacaagctattcatacattcccagtctttcagcagctcagtagcacagtcccacatgctatccacaaggtatgctgcatgctcatgtaactcactnttctagaaagaaaaaaaccaatgtcttaacaaggttggcatttggaccttgtcttcctcttcttttcatcattccatcctcctctggatctctacgactgaagagctttttgtagagaaattctccagctgctactgctactggccggtgagctgaataaaccagatgatagacattttcacaatcttctgcagtgagaacttcttcactactctgtaaaacaagagtgagtaattttattgcttgtactgcaacatcatattctttgtcaagggtcatagacacaattctatccttgaaccgactggtaaaaagttccagtttggaattaagctctttgttataataaagcccttgtagagcagtaagacatttgagtcttacttcaccttgcttatcatgcatagtccaaccaacatattttaaataactgtcattaagaaaggcatcactatacatcttcatccaaatgccaatctcttcaatgcaaatagctcgaatttcagctatcgcatcacggtatctatgtacaaacactcctttaaatattgcattcatcatattttctatttcatcttgattttcctgaagctctttccgcttttgtagcaggagttctagcctctcattggctcgttttccaatcattttattccgttctgcttcatattgtctttgtgtattatccatattaatgctaagatttagtgccacattcaccaaagctgtcatcaacttcatagctgccagggtgcttgtatgtcgaaatgctctgacttgtgagtcagacaatcctgtaagaagtgaaatgactgtatccatcatanactcatcatatatgatactatattgncattgccgtactaacacgccaatgaattcacaaaaactggatttgaacttcttccantgaggaccagccatggtaagtggataatctccactatcctcatcgaattcttcagtcatttttcgaattatctcagagttctgcatatgtctanacatttctgctgtgacnactcctttacagcctgaacactgaataaaaaagttgataaggtcaagaagtgctatatctcggtcatgcttgtatgattctatccnatcatctaccaccgactgcatagcactcttgcccattttaacaacttcaaacancatcatgttttccactccattctgttggtgatgaccattcattcggtntggaccagaaggaggttttcctcctccatttccacctttgcccttttctgctgggccctttttgcctntttttacaagttttgcctttgccttgcttttggttttttccttcgatatcttcaaaatctgtgtcagaagaaaaatgtgtttctgactcctgtagtagattaaaatcagttggtatttctggagctgctatcatttctttatcatcttctggaacacctcaatgtcagaaatatattcatatatttacgtgggntaaaatggtggcttgccttctttcttctaagacaattccgaagtcgggcctcggaagggatggagagatcgatgccannnnnnnnnccnnnnnnnnncccccacnnnnngnngnngatgatgggnnggggnnnannnag

SEQ ID NO: 342 - DNA, 688 bp, Homo sapiens; identical to SEQ ID NO: 185

SEQ ID NO: 343 - DNA, 1288 bp, Homo sapiens
aaggaacgccggctcttcgcctctcagcgcggcttgtcctttgttccggacgcccgctcctcagccctgcggctcctggggtcgctgctgcatcccgcacgcctccaccggctgcagacccatggccgagcgcggggaactcgacttgaccggcgccaaacagaacacaggagtgtggctagtcaaggttcctaaatatttgtcacagcaatgggctaaagcttctggaagaggtgaagttgggaaactgcggattgccaagactcaaggaaggactgaggtgtcatttactttgaatgaggatcttgcaaatattcatgatattggtggaaaaccagcttcagtcagtgctcctagagaacatccatttgtcttgcaaagtgttggaggacagacattaacagtatttactgagagctcatcagataagctgtcattggaaggaatagtggtacaaagagctgaatgccgaccagctgccagtgaaaactacatgcgattaaaaagattgcaaatagaagagtcttccaaaccagtgaggctatcacaacagctggacaaagttgtaacaaccaattacaaacctgttgctaatcatcaatacaatatcgaatatgaaaggaaaaagaaagaagacggaaagcgagctcgagctgataaacaacatgttttagacatgctattttcagcctttgagaaacatcaatactataatcttaaggacttggtggacatcacaaaacaacctgtggtgtacctgaaggaaatcttaaaagaaattggtgttcagaatgtaaaagggatccacaaaaacacatgggagctgaagccagagtacagacactatcaaggagaagaaaagagtgactaagaagactcctagccagcatgctagtgaaacgactagcagcgatgctatgcaaaaggcgctgatactggaaggcttgaacaccgtatgttaataggggttaagtgacagtactttgatttctctcggtaaattttttaaacctgtaattcttgtaaagtttcttaactgtttttttgaggagaaagaacagatttatttatagacttaacttgtattaaaccagattattcacagtaggaataggggttggaggattaagagggtttttcttaaatattagcttttaatgtgtacaattaggaaatttttttaagtgaggactctctacccttgccgtatctaaggagctgaggtaatacagatccaaggagaattgtatagcaagaaaaaaaaaaaaaaaaaaaaaaaaaaaaaaaa

SEQ ID NO: 344 - DNA, 2196 bp, Homo sapiens
cggggtgtcttgggcccgggcggctgtagaggcggcggcgcctacgggcagtgggaggagccgcgcggttccggctgctccggcgaggcgacccttgggtcggcgctgcgggcaggtggcaggtaggtggcggacggccgcggttctccggcaagcgcaggcggcggagtcccccacggcgcccgaagcgcccccccgcacccccggcctccagcgttgaggcgggggagtgaggagatgccgacccagagggacagcagcaccatgtcccacacggtcgcaggcggcggcagcggggaccattcccaccaggtccgggtgaaagcctactaccgcggggatatcatgataacacattttgaaccttccatctcctttgagggcctttgcaatgaggttcgagacatgtgttcttttgacaacgaacagctcttcaccatgaaatggatagatgaggaaggagacccgtgtacagtatcatctcagttggagttagaagaagcctttagactttatgagctaaacaaggattctgaactcttgattcatgtgttcccttgtgtaccagaacgtcctgggatgccttgtccaggagaagataaatccatctaccgtagaggtgcacgccgctggagaaagctttattgtgccaatggccacactttccaagccaagcgtttcaacaggcgtgctcactgtgccatctgcacagaccgaatatggggacttggacgccaaggatataagtgcatcaactgcaaactcttggttcataagaagtgccataaactcgtcacaattgaatgtgggcggcattctttgccacaggaaccagtgatgcccatggatcagtcatccatgcattctgaccatgcacagacagtaattccatataatccttcaagtcatgagagtttggatcaagttggtgaagaaaaagaggcaatgaacaccagggaaagtggcaaagcttcatccagtctaggtcttcaggattttgatttgctccgggtaataggaagaggaagttatgccaaagtactgttggttcgattaaaaaaaacagatcgtatttatgcaatgaaagttgtgaaaaaagagcttgttaatgatgatgaggatattgattgggtacagacagagaagcatgtgtttgagcaggcatccaatcatcctttccttgttgggctgcattcttgctttcagacagaaagcagattgttctttgttatagagtatgtaaatggaggagacctaatgtttcatatgcagcgacaaagaaaacttcctgaagaacatgccagattttactctgcagaaatcagtctagcattaaattatcttcatgagcgagggataatttatagagatttgaaactggacaatgtattactggactctgaaggccacattaaactcactgactacggcatgtgtaaggaaggattacggccaggagatacaaccagcactttctgtggtactcctaattacattgctcctgaaattttaagaggagaagattatggtttcagtgttgactggtgggctcttggagtgctcatgtttgagatgatggcaggaaggtctccatttgatattgttgggagctccgataaccctgaccagaacacagaggattatctcttccaagttattttggaaaaacaaattcgcataccacgttctctgtctgtaaaagctgcaagtgttctgaagagttttcttaataaggaccctaaggaacgattgggttgtcatcctcaaacaggatttgctgatattcagggacacccgttcttccgaaatgttgattgggatatgatggagcaaaaacaggtggtacctccctttaaaccaaatatttctggggaatttggtttggacaactttgattctcagtttactaatgaacctgtccagctcactccagatgacgatgacattgtgaggaagattgatcagtctgaatttgaaggttttgagtatatcaatcctcttttgatgtctgcagaagaatgtgtctgatcctcatttttcaaccatgtattctactcatgttgccatttaatgcatggataaacttgctgcaagcctggatacaattaaccattttatatttgccacctacaaaaaaacacccaatatcttctcttgtagactatatgaatcaattattacatctcgacccggaat

SEQ ID NO: 345 - DNA, 932 bp, Homo sapiens
atgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagaaaacgcccactcctggatcttcacattgaactcaatggctacatgtatgattggaacagcagagtttctgccaaggagaaatattatgtttggctgcagcacactctgagaaagaaacttatcctctcctacacataa

SEQ ID NO: 346 - DNA, 1582 bp, Homo sapiens
ggcacgaggcttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgcaaaaaaaaaaaaaaaaaaaaaaaaaaaaaaa

SEQ ID NO: 347 - DNA, 1543 bp, Homo sapiens
  modified_base (52)..(55): a, c, g, or t
  modified_base (107)..(107): a, c, g, or t
  modified_base (738)..(738): a, c, g, or t
  modified_base (1093)..(1093): a, c, g, or t
  modified_base (1121)..(1122): a, c, g, or t
  modified_base (1360)..(1360): a, c, g, or t
  modified_base (1518)..(1519): a, c, g, or t
ggacgtggggcggtgcgcggggctgggcggcggctgaggcgcgtgctctcgnnnngtcgctgggtctgcgtcttcccgagccagtgtgctgagctctccgcgtcgcnctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggnttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaaggnaggtttaaaaaaaaaaaaaaaaaaaaanngattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggnagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaannaaaaaaaaaaaaaaaaaaaaaaaa

SEQ ID NO: 348 - DNA, 3067 bp, Homo sapiens
  modified_base (22)..(28): a, c, g, or t
  modified_base (696)..(697): a, c, g, or t
  modified_base (699)..(701): a, c, g, or t
  modified_base (2920)..(2920): a, c, g, or t
  modified_base (2925)..(2926): a, c, g, or t
ttttttttttttttttttttannnnnnnttctgtgaataggtttattaagaccacctaggagaacctctttggcaactaccacaaattctaggccatttaaaatccaggccaagttcatatttgctctccatgatcaccattacaacaaccacaggtcacacagtattacagaacaaaagcatggtcactttattttacccaaatgcaaatcgtttttcacaaccaagacttttttctttcctacaatgttacaaatgatgtatccaagtccgactgtaatttggagttaaacagggatcatagaaccaaggaattatctctgaagctgctctttgggccactgtgccaccccaacagctctatcctgttgttcttttttttaattaaaaaatcattaaaaaaaaaatggagatggggtcttgctatactgcccaggctgatcttgaactcttgggctcagacgtaccgatatactgatcctcccgcctcagccttccaaagtgttgggattacaagtgtgagccattgcactcagccatctctacacactgtttttcaaggaaaggcagctacacctattccgtctccaaaccaaccctcacctggtgtccagttttcttggaagtctcaatttttctcatgacagcacattacctaatacctaccacattaggatgttaactcataaaaacatnntnnnaaagctttaaaaaacatttatttgtattaagtaagtgcaacagtgcaaagaaacttatgcatttgggcccttgcttccctactgttcacattagtttagtttagaagattaagtataataacagaaggagaacagaagaaatgaatataaatatactcagggtagccaaatcctctaattcactaaaggatgaaccaaagttgttggccagattcacatttatgtgggagcctaaacaaattatgttccctttaactgttctaggcctgtggaaaagggaagtggacaacatttatattacaagacagtaattttattgaaacatctttttttgtctaaaactatgcatggagatattaatctcttgtttataaattaggttaagtctaacatcactatttgaaaccagtgttatttacaaaaatgaacctcttctttgctttattgttggtttacaggaataattttaaaccaacctcaatctatctttaaaaatcttcctgccttcaaatgcccagcaacccttataaggtagggggcagccctttgacagcaacattcatcattcaccaggaatgtagaaccacaagtgaacaacaacaacaacaacaacaagattaaatcattcccaacaattcctatttgcttttccaaagcatgctatgtctaattctgcctttctatgcagacaggtgggagagggagcccatagagtatattaatgttaattaaattaacttcctttaaaagctaacaggatggcttagtgtggatgaggatgaactgctgtggatgacactagcagataatgaagtaaactttaaacccagattagtaacatgtactccagtaactgaccagctcagatagagacttctcatttactctggatcacatgtacaatattttaccttccaattaaatatagtgccaaaatctttcaaaatagatagagaataggcttcttagaaattcaaataaaaatgttaaataataaaaactggtggcctattatagagtttctgacagactccaatatactgggtaccagaaagtaactctatctcagatgctagtaaaaaggtaaattttgtatatacataaaagacaatattacgagactgtagtgtcatttgtcaaaacaagaatatctagaatggaattttcagtaaacacttgggatgaagggcaatcagaatacaagaggaagcaaaatccacataagttaattcctaatttgagaaatcaatagaatcaataaattgataattactgtctccataggtcacgaattccaaagactagttagtagttagtttctaactaaatgattacaggacgttctgatatatgctgtcttcttgtgatcagtttgttctggcaagacttcaacaagcacttgcccttgaaaacagctcagcgggagaacgatcggaggcaatcacttcgttttataaactagccagataataagtcccaagattagaataatcactgacaggacaagcaccaggatacacatcttcttgcgagattttttctgatagtaagcagctcgctgtaactgttcagtggctctttcgacgtgcacctctgagctttccacattggcttctatgctatcaatcagatcaccctggtcatggatcatcatggccaaatctttaaatatctgattgacatccaaaatgtcagcctccagctgccgaattgccgtttctctttctttaataagttccaaatcctgctcagtgatggccacctcatcctcctggctctgcatctggttccactcctcatggctgtcaaatgagaccagctgctcctctctttgcctctcttctgcagaaagacgagatccagctcttgctctggcaatactctccttttccttttcagatacccttctctgcacagcctggaaattgtttaaggctgcagagaagtcattcatgaggcgttccttctgaagtctctgctggcgctgttctgaagtagataagggaaggggcaaggaccctaattctttcagcaattcatttgtttccttggcgagctgatttgtggagtgttgtaactgttgcagattttcctgtagcttgcttgagtcctgcttagttcctagctggctcatcaaattctttatctgagcagtggcttggctgatccgctggatgttgccgctgcacgtctggatgatgctgctgaagtcccggagnctggnnccccgagggccccgggttccggtacatgtctaagggaccgtatgacatgacgaggagctgagacctgctcgctctacaccgctctcctaccggaagcagccgccagccgggacccgcaggctgacggagaaactgggaaga

SEQ ID NO: 349 - DNA, 5649 bp, Homo sapiens
  modified_base (58)..(58): a, c, g, or t
  modified_base (60)..(61): a, c, g, or t
  modified_base (63)..(63): a, c, g, or t
  modified_base (66)..(68): a, c, g, or t
  modified_base (141)..(141): a, c, g, or t
  modified_base (143)..(143): a, c, g, or t
  modified_base (172)..(172): a, c, g, or t
  modified_base (184)..(184): a, c, g, or t
  modified_base (219)..(219): a, c, g, or t
  modified_base (229)..(230): a, c, g, or t
  modified_base (282)..(282): a, c, g, or t
  modified_base (371)..(371): a, c, g, or t
  modified_base (402)..(402): a, c, g, or t
  modified_base (410)..(410): a, c, g, or t
  modified_base (414)..(424): a, c, g, or t
  modified_base (426)..(426): a, c, g, or t
  modified_base (463)..(463): a, c, g, or t
  modified_base (471)..(471): a, c, g, or t
  modified_base (480)..(480): a, c, g, or t
  modified_base (488)..(488): a, c, g, or t
  modified_base (545)..(545): a, c, g, or t
  modified_base (589)..(589): a, c, g, or t
  modified_base (594)..(594): a, c, g, or t
  modified_base (852)..(853): a, c, g, or t
  modified_base (858)..(858): a, c, g, or t
  modified_base (860)..(866): a, c, g, or t
  modified_base (868)..(870): a, c, g, or t
  modified_base (953)..(955): a, c, g, or t
  modified_base (957)..(957): a, c, g, or t
  modified_base (1163)..(1163): a, c, g, or t
  modified_base (1259)..(1259): a, c, g, or t
  modified_base (1288)..(1288): a, c, g, or t
  modified_base (1511)..(1511): a, c, g, or t
  modified_base (1559)..(1561): a, c, g, or t
  modified_base (1587)..(1588): a, c, g, or t
  modified_base (2080)..(2084): a, c, g, or t
  modified_base (2087)..(2089): a, c, g, or t
  modified_base (2101)..(2101): a, c, g, or t
  modified_base (2285)..(2285): a, c, g, or t
  modified_base (2567)..(2567): a, c, g, or t
  modified_base (2569)..(2570): a, c, g, or t
  modified_base (2713)..(2715): a, c, g, or t
  modified_base (3059)..(3059): a, c, g, or t
  modified_base (3061)..(3061): a, c, g, or t
  modified_base (3949)..(3951): a, c, g, or t
  modified_base (3953)..(3953): a, c, g, or t
  modified_base (3970)..(3974): a, c, g, or t
  modified_base (3977)..(3979): a, c, g, or t
  modified_base (4140)..(4140): a, c, g, or t
  modified_base (4393)..(4393): a, c, g, or t
  modified_base (4423)..(4424): a, c, g, or t
  modified_base (4430)..(4430): a, c, g, or t
  modified_base (4505)..(4505): a, c, g, or t
  modified_base (4512)..(4519): a, c, g, or t
  modified_base (4521)..(4521): a, c, g, or t
  modified_base (4523)..(4524): a, c, g, or t
  modified_base (4526)..(4527): a, c, g, or t
  modified_base (4530)..(4530): a, c, g, or t
  modified_base (4532)..(4533): a, c, g, or t
  modified_base (4535)..(4535): a, c, g, or t
  modified_base (4629)..(4629): a, c, g, or t
  modified_base (4796)..(4796): a, c, g, or t
  modified_base (5498)..(5498): a, c, g, or t
  modified_base (5523)..(5531): a, c, g, or t
gtcgactcggtcatgtgtctcatgtatgaagccactcccatcccagaggctaagctgncnncngtnnncgtgaggaaggagcggaagcgacacaaaacagacccctcagctgcaggcaggaagaagaagcagcgtcacggngnaggcggtcgtccctcctcggtccctgttntgaccgcgcaancaccaggacttctgaaaattcgcagagagggcaangagcagaagnngaatattctgctgaagcagcaggtgccattcgccaagcccctgccaactttngccaaacccacagctgagcctggtcaagacaaccccgagtggctcatcagtgaggactgggcgctgctgcaggctgtaaagcagttacnggagctgcctttgaacctcacaatcgtgtcnacctgctncacnnnnnnnnnnngngatcttgtcagtgacgttgttaactcctgtagccgantctaccgntcttccaanacagtgcnggaatcgctacgagaatgtcatcattccacgagaggaggggaagagtaaaaacaacngtcctctccgtacgagccagatctatgcccaggatgagaatgcnacacncacccagctgtacacgagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagcnnccccngnnnnnnncnnngcccccaccacccccgcagcagccaccgccaccgctgccacaaccacaggcagcgggcagccagccgccagcagggccaccannngnccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccaccnttccagtccatcaacaagcgcctggcgtcgccagtggctcctggggccttgactacgccgggaggctctgctcccgcccaggtggtgcacacccancccccgccacgggcagtcggctccccagncacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcancaacagcagcagcagcagcagcagcagcagcagcagcagcagcagcannnacagcagcagcagcaacagacgacgnngacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccagcagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcaactgcagtcgcaagggcagatgcagacccaggcaccccagccagcccaggtgcccttgccgaagcctccggtggtgtccgtcccggcagctgtggtctcctcaccgggagtcaccaccctgcccatgaacgtcgcggggatcagcgtggcgatcggtcagccacagaaggnnnnnggnnngaccgtggtggncccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagancccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacgncnncggccccgctccagactccaggcgctcccaacccagcccaggtgcccgccagctccgacagcccaagccagcagcccaagttacagatgagggtccctgctgtcaggctaaagacacctactaagcctccgtgccagtagtcnnngcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcancnccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaannnanaaaaaaaaaaaaaaaannnnnaannnttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgnatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctncctggcttggcacgtgccgtgagagcgcannttgccnggagggagggccgctgtgtgcgcctcacatctggctcccagtggaaacttttactcctcctcatccgcagatgtnatagaannnnnnnntntnngnnttntnncnttgtcatttgttttaatttgtgtgccctgttcattttttttgtctttcccaaatcttggtagtctccttatagttgaagataaaatgttgagtncacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgngggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttatanaaaaaaaaaaaaaaaaaaaaaaaannnnnnnnncggtccccaattccccctatagtgagtcgtattacaattaactgggccggcgttttttacaaccgttcgtgacttgggaaaaaacccctggggggttaccccaaacctttaaattcgc

SEQ ID NO: 350 - DNA, 5658 bp, Homo sapiens
  modified_base (120)..(120): a, c, g, or t
  modified_base (179)..(179): a, c, g, or t
  modified_base (666)..(666): a, c, g, or t
  modified_base (723)..(723): a, c, g, or t
  modified_base (1451)..(1451): a, c, g, or t
  modified_base (1453)..(1470): a, c, g, or t
  modified_base (1472)..(1475): a, c, g, or t
  modified_base (1477)..(1477): a, c, g, or t
  modified_base (1479)..(1480): a, c, g, or t
  modified_base (1482)..(1482): a, c, g, or t
  modified_base (1485)..(1485): a, c, g, or t
  modified_base (1487)..(1487): a, c, g, or t
  modified_base (1489)..(1489): a, c, g, or t
  modified_base (1491)..(1491): a, c, g, or t
  modified_base (1493)..(1497): a, c, g, or t
  modified_base (1499)..(1500): a, c, g, or t
  modified_base (2361)..(2361): a, c, g, or t
  modified_base (2638)..(2638): a, c, g, or t
  modified_base (2680)..(2680): a, c, g, or t
  modified_base (2685)..(2685): a, c, g, or t
  modified_base (2696)..(2696): a, c, g, or t
  modified_base (2708)..(2708): a, c, g, or t
  modified_base (2710)..(2710): a, c, g, or t
  modified_base (2726)..(2726): a, c, g, or t
  modified_base (3083)..(3084): a, c, g, or t
  modified_base (3549)..(3550): a, c, g, or t
  modified_base (4425)..(4425): a, c, g, or t
  modified_base (4929)..(4931): a, c, g, or t
  modified_base (5033)..(5033): a, c, g, or t
  modified_base (5118)..(5118): a, c, g, or t
  modified_base (5643)..(5644): a, c, g, or t
  modified_base (5646)..(5648): a, c, g, or t
cgagacgctgaagagaaccagggctaccagaagcagcaacagcagcgagagtatcgcttccgccatttccatgaaaatttttattttgatgaatccttttttcacttcccttttaattcntgaacggcgggactcaattgacgaaaagtatttattgcacttttcacattatgtgaatnaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatganaaggcggtacaacatcaatatctacgcccctaccctcttggtctttaaagaacatanaaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaancnnnnnnnnnnnnnnnnnnannnnancnnanctncncnanannnnncnncagcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactgggagcagctgcctacacttctccttcctgagtctagataaacacagagaatggctagaatacttactagaatttgctcaagatgcagctccaatcccaaaccaatatgataagcatttcatggagcgtgactacactggttatgtactggctctgaatggccacaagaaatacttctgcctcttcaagccccaaaagacagtcgaagaggaggaagccatagggtcgtgcagtgatgttgactcttccctctacctgggtgaatctcgagggaaaccttcctgtggccttggatccaggcccatcaaaggaaagttgagcaagctctctttatggatggaacgcctgctggagggctccttacagaggttttatatcccatcatggcctgaactagactgagaggattttccaaagagatttgaactcttcagactttttaacatgcccctgtgaacaggtattttcaggactcaaactaccacaatgaacagagtatagattttagattgctcttctagaaccatggctagaagaatctttcctttgtcctgttctaacctaggaatgaaaaacaccaccagtttgaatcgcctagatgaaaatcttttcctctgggtgttatttttccccactgaatgccacaccattgaaaatagactgctcatcccctcttcctttcttgtccntgtcccatgctcaccccaccctcctgtcctgtgtcttggagaagcacagggctccaccctgcaagcggcatctggcggaccctcatgagcctgtcgtgcaggccaggtcattggccccttccccaatcccggccctgctgtgctgctgccatggcgcatgctcctaactctgaacaacccacggcagcttctagccccgcatctggaaaaaggcccctttccaagcaatctcacgtttactggttgttctgggagtaagtggctaaatgtatatttngggggtatcccccaacaacagtttgttggccacaggttgaanagganaggaataaacnggagttctgcangngagttctcaagaaaanggaaagggaggctgagcagtggctgaagcgatgcagccttgagacacgctgtgagcatcccatccgccgccccagcgctgctggtagccaggggaggggtctgcacagcgagaagtactgtgatgactttgagccgttgacatgtatgtcttcagatgcctttctgcctctgtcgattttagggtatggatattaggagccataacttgtaatcttgttctctgaacgtagagataagctgctataaagccagtagatgttaaactgaagagaaattattcccacctgctatgagtcaggcttaaggaatctcttcaatagtgtctctttagtaaaataccaaacatgtctttgtannaaggaacttaaaatttctcaacaattgtattttgaacactgttaccctaaaagtgctgtctcttcaagtcatcttttgcaggaagtgagccaagatttgttctagactcccattttgcaaaaggcttactttccacttctgggctgtattttgatgtctcatcttcattgttttcactcttaacttagagctgcttcaccagtattggggtcagactggccatcagcacctgagcgtgctgagctccaggtatagtggaccccagggtgcctcataccagccagttagagagcataccttttatttttcagggcagaatgaccagtggttctgagtttgagtttggacagcttcaaagagtggtccgttcaaatgtcaaagcaaggtgcctttggtggctttgtgaagggtgaaaatcagtgatgggacatttactaagtatttctttttttttttttttttttnnagttgttgagacagagtttcactcttgttgcccaggctggagtgaaatggtgcgatctcggttcaccgcaacctccacatcccaggttcaagtgattctcctgcctcagcctcctgagtagctaggattacaggcatgtgccaccatgtaattagcccggctaattttgtatttttagtagagacgggatttctccatgttgatcaggctggtcatgaactcctgacctcaggtgatctgcctgcctcagcctcccaaagtgctgctgggattacaggcgtgagccaccactcccggctaagttagtatttctttaatcttaatgctttaaactaagccacttggatcctgaataatttaaatcttgagctacattggtaagtaataaattatttaaggccaggaattcctgtagttttcatggagtctgtagctttattaaaaaataaatcactgccaggcttcattcttccatatgatcctctaaaaatggacacttcctctgaatgctgtatctcatggcacctggtccaactagaaatggtcaaggaattcatttggctccttgatacatcagtcctcaatattactttctaggtattttatggccagattgcttatatgagtggtcttttggtttggtagtaggtttttatttttaatttctgtactaatgaaattcctgactttaatttctgaaaaccaaaaactctccaagtgtatttatttatattttttttaatagagacgaggtcttgctatgttgcccaggctggtcccaaactcctggcctcaagcagtccttccaccttggcctcccaaagtgctgggattatcaatatgagccaccatgccagatttgttcatttttaaanatttttatctcttcaagtcatcttttgatcttttaaaaagcaccttcaaacagctgcaccttccatttgcactaggaaatgaaggtagtgatgggattggcaatgttcctggcagatgtttcagcccaaaagctcttctacagaccggtttagagctggtgccctatgagaatattagggagcttttattttaaattgaactttacccttgtccatgcaaggcattcctcctgaatgcatccatgaatttgtttacttttgcgtcaaacatatgagccattgtcatgctcagcctgtgccaccattgctctgtctgatgtatgtaatcatacaagacctgattttggttctaacacagtggtctttgactatcaacattgatgtttttagagatgggttcttctggttgatacagactatgcattgcgtttagcagatggggtaaaactggcctaaaacaagtctttgcagaatacatgccaatttccaaaaaaaaaaaaaaannntttgttgctcaggtgttgcacaatttttatctaacactgaggctatcagctccaactaaacaacatttcagtgggtgaggctgccctaacttccattagggnccatggtctcactgccatcacttattagccatgagaatttggttgtagttttcaggtaggttggtttcttcctcatttgcagctngttgatacttgttcctttttatttattaacatcccaatcaatttgcagctgccatcattacataaatatttttctgttataaaaagaagtgtgatctgtttttttagtgatttcctttgtttgggaatagagattggaagcacatactcagacctgttttgttaactagaattctttaaaagctgatgccaaacatctttacagaggaactgtagttcacatccacctgtctgacattgtcccctaaaaacaagtgcagtgtggcagctgctgaatctgtctgttcagtttgtcaaggaggataattatgcttgggagagatctgaaaagaaggtgaatattttgcacttttgatactcttaggaacaaataacttatttggcaaattgtttcttttttatgttttgggtgttgtttttgttttttgactttttttgtattgtgaacaggcactgaagctgatgttattttaagattacagaatggaaaaagaaataaactattttaatgtctgataaaaaaaannannnaaaaaaaaaa

SEQ ID NO: 351 - DNA, 3761 bp, Homo sapiens
  modified_base (708)..(708): a, c, g, or t
  modified_base (712)..(712): a, c, g, or t
  modified_base (720)..(720): a, c, g, or t
  modified_base (1887)..(1887): a, c, g, or t
  modified_base (1889)..(1891): a, c, g, or t
  modified_base (1893)..(1896): a, c, g, or t
  modified_base (1900)..(1903): a, c, g, or t
  modified_base (1905)..(1913): a, c, g, or t
  modified_base (1979)..(1979): a, c, g, or t
  modified_base (2048)..(2048): a, c, g, or t
  modified_base (2109)..(2109): a, c, g, or t
  modified_base (2160)..(2160): a, c, g, or t
  modified_base (2291)..(2291): a, c, g, or t
  modified_base (2294)..(2294): a, c, g, or t
  modified_base (2337)..(2337): a, c, g, or t
  modified_base (2388)..(2388): a, c, g, or t
gcacgagggatagcttttacatcatagagtctggcgaagtgagcatcttgattagaagcaggactaaatcaaacaaggatggtgggaaccaggaggtcgagattgcccgctgccataaggggcagtacttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatcttgggttcaaaacggcatgtctctccaacaatttaagtgcctgatacaaagtccaaagtataaacatggcttcccctttttttcccctttctttccttttggcctgtgccgtanctcntgtgcttntggaagttaccacagggtctgcagaaacctgttgtataactgtagacactctctaatggttctcaaaggaggaaatgtagccttcagtctcctcatttgtcctttgaggaagtccacatttgttcacagttgcaacctttggttttacagtgggaaatggtggtggatgatatggacatatgtagcccagtggcattgtacttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgcttaagaccagcctaggcaacagagtgagatcctgtctctacaaaaacaaaaattttttttttgttttctttttgagacggagtttcgctcttgttgcccaggctggagtgcagtggtgcggtcttggctcaccgcaacctccgcctcccagattaaagtgattctcctgcctcagcctcctgagtagctgggattacaggcatgcgccaccatgccgggcgaattttgtatttttaatagagacagggtttctctgtgttggtcaggctggtctcaaactcccaacctcaggtgatccgcccacctcagcctctcagagtgctgggattacagatgtgagccactgcacctggcaaaaaaaaattttttttttaattngnnngnnnnggtnnnncnnnnnnnnngtcccaaatacttaggaggctgaggtggaaggatcacttgagcccaggaggtcaaggcaacagtgngctgtgatcatgccactgcactccagtctgggtgacacagtgagaccctgtctcttaaaaaaaaaaaangaaagaaaaaaaattattctttaggtaatttcacttggacatattcatgtatatggagttngtcagctgactcaggcatttaccctaaagatcaaatctgttttcaaaaatnggcattggccaggcacggtgacccacacctgtaatcccagcactttgggaggccgaggcgggcggatcacgaggtcaggggttcaagaccagcctggccaacatagtgaaaccccgtctctactaaaaatncanaaaattagctgggcatggtggtgggcgcctgtaatcccagctncttgagaggctcaggcaggagaatcgcttgaacctgggagtggaggttgcngtgagccgagattgcaccattgtattccaccccgggtgacagtgcaagactccatctcaaaaaaaaaaaaaaaatttggcatcatttacaatttcatagaattactgtgaaggcctttctagttgagatgttggggtatttgggattctaattgttaaccccagaagaaggtaatttagcttgtatttatttaaaacccatttagccttttacttatatctggtagaattccagtgatcatcctaataaggtatatttcagaataatttttttttccttcagaataacttagaatcagatgctataagggctcctaggagcagtgtgaaatttccgtaaagataaatttgaatgttgtaaccaagtttatattaaaccaagaggccatttccaatatgattttttgtttctttttaacttgttaagtccctaagagattacatgctagggcttgagtcatttctattgtagataatgatggcccacacagtcaccttcaactatccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaaacaggtcttgcccttagcagacaagaaccacaccagtttcttgtaaaggtaacggatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaagtcgacgcggccgcgaatttagtagtagtaggcggccgctctagaggatccaagcttacgtacgcgtgcatgcgacgtcatagctcttctatagtgtcacctaaattcaat

SEQ ID NO: 352 - DNA, 1689 bp, Homo sapiens
  modified_base (15)..(15): a, c, g, or t
  modified_base (17)..(18): a, c, g, or t
  modified_base (20)..(22): a, c, g, or t
  modified_base (25)..(25): a, c, g, or t
  modified_base (1137)..(1137): a, c, g, or t
  modified_base (1415)..(1415): a, c, g, or t
  modified_base (1471)..(1471): a, c, g, or t
  modified_base (1526)..(1526): a, c, g, or t
  modified_base (1533)..(1533): a, c, g, or t
  modified_base (1536)..(1536): a, c, g, or t
  modified_base (1542)..(1542): a, c, g, or t
  modified_base (1546)..(1546): a, c, g, or t
  modified_base (1558)..(1558): a, c, g, or t
  modified_base (1561)..(1562): a, c, g, or t
  modified_base (1595)..(1595): a, c, g, or t
gctgacgcctactantnntnnnttntttttttttttcagagttttagatattatttattttaaactaaagcaaataacaagttaagtgaaatttgcagttttcactttgcattgtctatttaaaaggcctaggtattggagctgaaatgctgaagaggctaagtcaggtatgtattacaattagtattgatattctatacattaaccttttcttaataaatattcacagggcataaattaaatcattaatctcaccatttgaacataaccccaacatatacttcaaatttctacccaaattaaactggattttcaaatcagatgatcatatacagtatatgaattatagtcaattaaaattgatttatatataatccacaaccacactatacaccctttttgctatcaagggaaagtaagaaggagggagattagaaagcatttttattcaaaaacacaggctcacagtatgaatattacaagactataaaagcaagatcttcttgtattttggaaacatatgagaacatgtgttcttttaggtacaccttttctgtatgataaaggctttgcaaatcagttttgagattttaaagagggctttaaagctcagaacagtgagacttttttctttttacagctatagaaaagttcaaaaggtaactactatatttggaagtattattcacacatagtgtcttgcatagagtagaccttcaataaaatatatgtgttaacgaagattatactttcaaatgaaagtaatatttgcttgtttgtttttaaacagatagccatcacaactcaatgtaactgcatgcactttcttgtcgtcatttggaaccaggcttctatcaactactatactagtcgaggggctttagacctttcctctgaggagggctggcatctcttcaggtttaacagagaagaactcctggacatggcatgggaagaatgaaagaggctttgtaacaactcatcccaacacagcctccaacatttgactgtcacctgagtctaacagcagtttgactttgttgtacaatacagcaagtgatcatcacattcttgtttgagcagatcttttattttgaaacagattttgtagctctagtcaactttccattatccaanccaatattctaacggctagtagcagtagtgataatccaaaagagcagataatttaaaagtcacttatacttagctttgcgctattttttacctatcatatttcatcaaaattaaggtgcttttcacaatttgacatatctgatgtcgggataaatgtaatgatcaactggcagcattttttgtttgtttgtttttagaggcaggatcttgctatgttgctcaggctggtctcaaacttttggcctcaagcaatcctcccacttcagcctcccagacanaagcaactctgctcagcctttttttttaaattaaaggtatatgatatgccttaganttgatgaaatatgggtgtttgaatatattcagatctgaggtttaaaaaaattcanttcaaanacnggaganaaantctgaagagccnacnnatgaaaaactagcaagtaaactgcttccctacnttgagcagcttaagtaccactgcctccttgacatcatcccagtactacattctatctctgaacatccatagctctttggttgtacttatcttag

SEQ ID NO: 353 - DNA, 976 bp, Homo sapiens
  modified_base (210)..(243): a, c, g, or t
  modified_base (321)..(321): a, c, g, or t
  modified_base (442)..(442): a, c, g, or t
  modified_base (475)..(475): a, c, g, or t
  modified_base (507)..(507): a, c, g, or t
tggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaatnnnnnnnnnnnnnnnnnnnnnnnnnnnnnnnnnnaagaaaatttcactgccgaccatccattccttttctttattcggcataattcctcaggtagcatcctattcttggggnagattttcttccccttagaagaaagagactgtagcaatacaaaaatcaagcttagtgctttattacctgagtttttaatagagccaatatgtcttatatctttaccaataaaaccactgtncagaaacaagtctttcattttctttgtaagttnggctctgttggctgtttacacccatgaatttnggcatgggtatctatttttcttttttacattgaaaaaaatccagtggttgcttttgaatgcatcaagtaaagaagaagaaaagaatacatccgatgcgtagattcttgaccatgtagtaatctataaaattgctatatcctcctgatagccatgggaaaacatgataagatggtcatttattttgcagttagaattttggaagccacaaaatagacagacaccctgactgttgaagggaggtttaaaaacagatattcaattgaaatgtaagagagcaccccaattgagagcccaggttacgaagacaagcttgcctcgcctgacttttctgtcccttgttctgcaggattagtattctgttacagacctctagtttttagactcttcaattaaagggccaatggttataacctgcaaaaaaaaaaaaaaaaaaaaaaaaaaaaaaaaaaaaaaaaaagggcggccgct

SEQ ID NO: 354 - DNA, 470 bp, Homo sapiens
  modified_base (123)..(123): a, c, g, or t
  modified_base (127)..(127): a, c, g, or t
  modified_base (447)..(447): a, c, g, or t
tttttttttttttttttttttttcacaagcacgtgcactttattgaatgacactgtagacaggtgtgtgggtataaactgctgtatctaggggcaggaccaagggggcaggggcaacagcccnagcngtgcagggccagcattgcacagtggagtgcaaaggttgcaggctatgggcggctactagtaaccccgtttttcctgtattatctgtaacataatatggtagactgtcacagagccgaataccagtaacaggatgaatccaatggtcatgaggatgcccagaatcagggcccagatgttcaggcacttggcggtggaggcataggcctgggccccggtcacgtcgccaaccatcttcctgtccctagacttcacggagtaggcgaatgctatgaagcccagacagcaccagttcaagaagagggtgttgaacagggaccanacgacatggtcgggcacggaggt

SEQ ID NO: 355 - DNA, 345 bp, Homo sapiens
  modified_base (23)..(24): a, c, g, or t
  modified_base (344)..(344): a, c, g, or t
ttttttttttttttttttttttnnttaacattccaaacatgtataaccaattaacatggcctagggttttctttttattggtattcacttcagtaacttgaatccacagatataagcagtatataaccagaaagttacaagtaaacacaaattatacatgcaaatttctgttcacaaaggtcacatgtgcaggtacatgaattagaagcgtgcatctaggattatggccaaactgttttaaaaatgcagaaatgtaaaattacatcttgaaaatatgaagagatggtctacacacttcaaaaatcaaatgttgcttataccagagatgtatgacaatcacgggnt

SEQ ID NO: 356 - DNA, 1896 bp, Homo sapiens
  modified_base (79)..(84): a, c, g, or t
  modified_base (86)..(88): a, c, g, or t
  modified_base (90)..(92): a, c, g, or t
  modified_base (94)..(94): a, c, g, or t
  modified_base (96)..(97): a, c, g, or t
  modified_base (100)..(104): a, c, g, or t
  modified_base (106)..(109): a, c, g, or t
  modified_base (111)..(112): a, c, g, or t
  modified_base (114)..(114): a, c, g, or t
  modified_base (116)..(121): a, c, g, or t
  modified_base (123)..(125): a, c, g, or t
  modified_base (210)..(210): a, c, g, or t
  modified_base (259)..(259): a, c, g, or t
  modified_base (270)..(270): a, c, g, or t
  modified_base (281)..(281): a, c, g, or t
  modified_base (285)..(285): a, c, g, or t
  modified_base (370)..(372): a, c, g, or t
  modified_base (374)..(374): a, c, g, or t
  modified_base (376)..(378): a, c, g, or t
cgtggcttgatcaccccctccccaataaagctaaaactcacctgagttgtagcttgagtgaagtggcgtgatcttggcnnnnnncnnncnnngncnntgnnnnnannnnanncncnnnnnntnnngtgctctatgcccaggtctctgtggctgggctgctccagcctggcggacagcatgccttcgctgcgatgcctgtataacccaggnactggcgcactcacagctttccagaattcctcagagagagaagactgtnataatggcganccccctaggangatnataccagagaagaattcacttagacagacatacaacagctgtgccagactctgcttaaaccaagaaacagtatgtttagcaagcnnngntnnnaagactgagaattgtgtggccaaaacaaaacttgccaatggcacttccagtatgattgtgcccaagcaacggaaactctcagcaagctatgaaaaggaaaaggaactgtgtgtcaaatactttgagcagtggtcagagtcagatcaagtggaatttgtggaacatcttatatcccaaatgtgtcattaccaacatgggcacataaactcgtatcttaaacctatgttgcagagagatttcataactgctctgccagctcggggattggatcatatcgctgagaacattctgtcatacctggatgccaaatcactatgtgctgctgaacttgtgtgcaaggaatggtaccgagtgacctctgatggcatgctgtggaagaagcttatcgagagaatggtcaggacagattctctgtggagaggcctggcagaacgaagaggatggggacagtatttattcaaaaacaaacctcctgacgggaatgctcctcccaactctttttatagagcactttatcctaaaattatacaagacattgagacaatagaatctaattggagatgtggaagacatagtttacagagaattcactgccgaagtgaaacaagcaaaggagtttactgtttacagtatgatgatcagaaaatagtaagcggccttcgagacaacacaatcaagatctgggataaaaacacattggaatgcaagcgaattctcacaggccatacaggttcagtcctctgtctccagtatgatgagagagtgatcataacaggatcatcggattccacggtcagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggtcggacaccgagctgctgtcaatgttgtagactttgatgacaagtacattgtttctgcatctggggatagaactataaaggtatggaacacaagtacttgtgaatttgtaaggaccttaaatggacacaaacgaggcattgcctgtttgcagtacagggacaggctggtagtgagtggctcatctgacaacactatcagattatgggacatagaatgtggtgcatgtttacgagtgttagaaggccatgaggaattggtgcgttgtattcgatttgataacaagaggatagtcagtggggcctatgatggaaaaattaaagtgtgggatcttgtggctgctttggacccccgtgctcctgcagggacactctgtctacggacccttgtggagcattccggaagagtttttcgactacagtttgatgaattccagattgtcagtagttcacatgatgacacaatcctcatctgggacttcctaaatgatccagctgcccaagctgaacccccccgttccccttctcgaacatacacctacatctccagataa

SEQ ID NO: 357 - DNA, 1760 bp, Homo sapiens
aaaacgtttgtatctcaagcaagtgctacaatgcaacagtatgcacagagagataagaaacatgaatattggtttgctgtgccacaagaaaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggagattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagatgatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttc

SEQ ID NO: 358 - DNA, 1474 bp, Homo sapiens
agacgccgggggcggacgggaggaccggaggaccgaggacagaaagattggtggacaggagcagcggccggtggggagggcgctcggcggcggcctgcggccatggccaccgtgatggcagcgacggcggcggagcgggcggtgctggaggaggagttccgctggctgctgcacgacgaggtgcacgctgtgttgaagcagctgcaggacatcctcaaggaggcctctctgcgcttcactctgccgggctccggcactgaggggcccgccaagcaagagaacttcatcctaggcagctgtggcacagaccaggtgaagggtgtgctgactctgcagggggatgccctcagccaggcggatgtgaacctgaagatgccccggaacaaccagctgctgcacttcgccttccgggaggacaagcagtggaagctgcagcagatccaggatgccagaaaccatgtgagccaagccatttacctgcttaccagccgggaccagagctaccagttcaagacgggcgctgaggtcctcaagctgatggacgcagtgatgctgcagctgaccagagcccgaaaccggctcaccacccccgccaccctcaccctccccgagatcgccgccagcggcctcacgcggatgttcgcccctgccctgccgtccgacctgctggtcaacgtctacatcaacctcaacaagctctgcctcacggtgtaccagctgcatgccctgcagcccaactccaccaagaacttccgcccagctgggggcgcggtgctgcatagccctggggccatgttcgagtggggctctcagcgcctggaggtgagccacgtgcacaaagtggagtgcgtgatcccctggctcaacgacgccctggtctacttcaccgtctccctgcagctctgccagcagctcaaggacaagatctccgtgttctccagctactggagctacagacccttctgatcacagcacccaggagcttgtctccaggaaggcggccccgtcccctactcatacccaccacagagcaccagccagtgccaacgccaggctgctatttatctccctatcccaccccctaccccacctaacacatttgcactgccaggaatggacactggaagtgccaggaggaaggaaggctggtttggtggggtagtggggaggtcagggaggcggggccaagggtgtcccacattcccaacaccgccctctgatcaccatgggaatctttggactcaggacagggccaggtgcagggctctccctcctctccccttcgctgtcccctccccctggagggcatggtgtcggggggtggcactgagctatgagtcccggggatggtgaggaacgccacagacagagccaccctaggagtgagtatagtgctggtgactgtgtttcatagccccagtccagggctgtctaagaaataaagatcatcagactccaaaaaaaaaaaaaaaaa

SEQ ID NO: 359 - DNA, 2058 bp, Homo sapiens
cggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgacttgcatcagactggaggtgaagttaccatttcagtatatgctaaaaactcacttccagaacttagccgagtagaagcaaatagcacattgttaaatgtcattattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgacacaacagattgagtgggagatggaaggaaggctattacattatttccgaatttttaatactgtgtgaagtggtggcttgctgctgtaatcttttgttttgttgttgtgttactgaatgtggcatttcagggttaacattaggttcttaaaagccaaagtcagtttgtctttttgtgcctctcatctttcttttgtgttatgtaagattgattattcatttctccctactggtaggaaccatagttgtgtcctatacttgaagaggctggaaagtagcccataaccataattgcagtatttctttgtatttctctgttaagcaaagaaatattaaggaacattttttttatgtttttgtattattccataattagtaaagcaagatgaaatgtcaaattttaatcagttttttcatggatttgtgttcttacagtacttgaaaatatttaaggaagagatgaagctctgcagttttttctatgtgggatgattacttttttaaggaggattaattctgaggtagtatagtaactaaaggggaatatatgaattgtttaacaaattagaatttgtttacaactacttgaatttttaaattatgtcaaaacttacattacttgccaagcagtatgatgttataggaaacataaataagattacagaggtatcaatttggttaaaattcaccattttataagactaagcaataatcttaacaacctctttcctgaatatttaaatgtgtttgtatggtgttatgactaattgttactgatttagagactaagccctcttaaaacctttagttaaatataaaaagaaattatatatatcttgcctccctgatggaaaactatataaaattgtagacttaaaaggtttgtggaaatacattaggatatcagaaaactaaatatatggagttgctttatgactattacatgttaaataaaaatagcttaattgttaaaaaaaaaaaaaaaaaaa

SEQ ID NO: 360 - DNA, 1271 bp, Homo sapiens
tgggcgcggccatgttggaggctccgggcccgagtgatggctgcgagctcagcaaccccagcgccagcagagtcagctgtgccgggcagatgctggaagtgcagccaggattgtatttcggtggggccgcggccgtcgcggagccagatcacctgagggaagcgggcatcacggccgtgctaacagtggactcggaggagcccagcttcaaggcggggcctggggtcgaggatctatggcgcctcttcgtgccagcgctggacaaacccgagacggacctactcagccatctggaccggtgcgtggccttcatcggtcaggcccgcgctgagggccgtgcggtgttggtgcactgtcatgcaggagtcagtcgaagtgtggccataataactgcttttctcatgaagactgaccaacttccctttgaaaaagcctatgaaaagctccagattctcaaaccagaggctaagatgaatgaggggtttgagtggcaactgaaattataccaggcaatgggatatgaagtggatacctctagtgcaatttataagcaatatcgtttacaaaaggttacagagaagtatccagaattgcagaatttacctcaagaactctttgctgttgacccaactaccgtttcacaaggattgaaagatgaggttctctacaagtgtagaaagtgcaggcgatcattatttcgaagttctagtattctggatcaccgtgaaggaagtggacctatagcctttgcccacaagagaatgacaccatcttccatgcttaccacagggaggcaagctcaatgtacatcttatttcattgaacctgtacagtggatggaatctgctttgttgggagtgatggatggacagcttctttgcccaaaatgcagtgccaagttgggttccttcaactggtatggtgaacagtgctcttgtggtaggtggataacacctgcttttcaaatacataagaatagagtggatgaaatgaaaatattgcctgttttgggatcacaaacaggaaaaatatgaacatgatattttatagcttgggaagaaacttgcagatgatatgtgctgcctttgcttcttatcattcatggcagattgttagtgctttcaacatttcatttgaaatgggagaagataaaatcacttgatgtaacctggaaactatgctttacatggcaatcaaagccttttgatcatgtacattttatttgatattaaaatcttttataaccagaaaaaaaaaaaaaaaaaaaaaaa

SEQ ID NO: 361 - DNA, 1535 bp, Homo sapiens
cgatatgccacacagtacttccaggtggagggataccgccaatgacaatgagggccactcggatggcctggcaagaagagggagaggcgagagttcaagtggctatcccgagccaaagtaccctgaagacaaacgggaagcgaggagtgaccaagtgaaaccagaaaaggtgccgagacgacgacgcaccatggccgaccctgacttctggacgcacagtgatgattactacaaatactgcgacgaagactctgacagtgacaaagagtggattgctgctctgcgtcggaaatatcgaagccgagagcaaaccctgtcctccagtggtgaaagctgggagactctgccggggaaagaagagcgggaacctccacaggctaaggtgagtgccagcactggcaccagccctggccccggtgctagtgccagtgccggggctggcgccggggccagtgctggcagcaatggcagcaattaccttgaagaagttcgagaaccatcccttcaggaagagcaggcatccctggaagaaggagaaattccttggctccagtaccatgagaatgacagtagcagtgagggggataatgattctggtcacgagttgatgcaacctggggtattcatgctggatggaaacaacaaccttgaagatgactccagtgtgagcgaagacctagaagtggattggagcctctttgatggatttgcagatgggttaggagtggctgaagccatttcctatgtggaccctcagttcctcacctacatggcacttgaagaacgcctggcccaggcaatggaaactgcccttgcgcacttggagtctctcgcagtggatgtagaggtggccaatccaccagcaagcaaggagagcattgacgctcttcccgagatcctggtcactgaagatcatggcgcagttggtcaggagatgtgctgccccatctgctgtagcgaatatgtgaagggggaggtggcaactgagctgccgtgccaccactatttccacaagccgtgtgtgtccatctggcttcagaagtcaggcacctgccccgtgtgccgctgcatgttccctcccccactctaaagaccaaggccgtttactcctggtctgattattttccccatctgaaatccacaatactgcaggagccctcttgaaattaacaatggaaataaaaccaatcagtcagttagcctaaacctattgattcctcgtgattatttccaatgtgaaaacagttgtgtatgattgcattaaaaatcatatcatcttttagaggttagaaaagggaaaactaaactttctaaatgctacttgagattgcagtaagaagatacgttttctaacctgaaagttaaatcgcatttgttttcttcagtagaatgggaatgtgttgctgttacttgtaatgtcaagtttatctgttaaatatgtccaaaaggcaaaatcatttttgttgcatgttatgggtcgatgttcctgtaattgcagtgccgtaaaagcttattaaagttgttcttttggtttt

SEQ ID NO: 362 - DNA, 1226 bp, Homo sapiens
gctgccgcatcccaggctaagcgccgcgccgaaagccgtgcggagattggaggccgcgcgggtccctggtctgggccatgtctggctgtgatgctggggagggagactgttgttcccggagatgcggcgcgcaggacaaggagcatccaagatacctgatcccagaactttgcaaacagttttaccatttaggctgggtcactgggactggaggaggaattagcttgaagcatggcgatgaaatctacattgctccttcaggagtgcaaaaggaacgaattcagcctgaagacatgtttgtttgtgatataaatgaaaaggacataagtggaccttcgccatcgaagaagctaaaaaaaagccagtgtactcctcttttcatgaatgcttacacaatgagaggagcaggtgcagtgattcatacccactctaaagctgctgtgatggccacacttctctttccaggacgggagtttaaaattacacatcaagagatgataaaaggaataaagaaatgtacttccggagggtattatagatatgatgatatgttagtggtacccattattgagaatacacctgaggagaagaccctcaaagatagaatggctcatgcaatgaatgaatacccagactcctgtgcagtactggtcagacgtcatggagtatatgtgtggggggaaacatgggagaaggccaaaaccatgtgtgagtgttatgactatttatttgatattgccgtatcaatgaagaaagtaggacttgatccttcacagctcccagttggagaaaatggaattgtctaagccaaaagaaagtctaattatatacagagataaagctaaacgtaattattatttaaatgaaagctatttttttaaatgaattgaaatttttcatgatgctactaatttgccactaaatactgcaaatggtcaccctgaatctcttctgacattggatgttatttgcttatattcttataattttaaatgagggcacagtgaaatgaaaattttatactctatgtttctgtttatttttaaatccttaacagcaaaatatttgcctttaatttcttttttatatatactctcgagagaattcctcttaatttttaaagatgctggtgataataaaattcattagaaaatttcctcattgtggaatgagcattctcttgttttaatgttggtgtcagaaaataaatatgaaacattaagtcc

SEQ ID NO: 363 - DNA, 2540 bp, Homo sapiens
attgggctgttgagcgggggccgaccgacggccaggagtttcttttctgcgcttgtgcgttttctgttcggtttccttcccgctagcggggccacgagggttgctaggcaacagcccctgggtgacttggtcttagggtcctgtccggcttggggctgatgaaaggagctgtccgcgcccgggctcttccgagaagtggttgctgacagccacaaagtgaaagggagtgaggcggcgtggacgagtaaggagtgacagtgaggattcacatttgggttatttcaagatgagcttcctactgcccaagctgactagcaaaaaggaagtagaccaggcgataaaaagtactgctgagaaggtgttggttctcaggtttgggagagatgaagatcctgtctgtctgcagctagatgatattctttctaagacctcttctgacttaagtaaaatggctgctatatacctggtggatgtggaccaaactgcagtttatacacagtattttgacatcagttatattccatctactgtctttttcttcaatgggcagcatatgaaagtggattatggatctccagatcacactaagtttgtgggaagcttcaaaaccaaacaagacttcatagatttgattgaagtaatctatcgaggagcaatgagggggaagcttattgtccaaagtcctattgatcccaagaatattcccaaatatgaccttctctatcaagacatttagtacattaattgctgtcaaagatgaagaagaaggcacatcttgacacagtacctgaatccagctgtgctgtgtttctggagtcctttggaaacatgtgtcccagaggagaagaggtttgacttgcgtgtagaaaacccggcccctgaggaaaagaccccactggttctctgatgacctgggatgcctaactgtctactccctgcaagcctcagagcagccaagtcattggtgttcattttccccacagtgatttttgtaacttctctttctaatgtttttctttatccctttaatacagaaccctcccaaacattggctagtacaacttgatttcatcatgttcatttgatacacaagtgaactggaaagtcacttcccatagaagcaaaagtacttattttctaccctagctgggtgcatgtgtgtgcacacacacacacacacacacccccacacccctttgccggttcctcgactcatacatccctcgtgctttcccatctccagtctgtattactgtaggttctcttcaaataattaattgagcagacaagtttgttttattttggagcctttttggctctggcttttaaacattgtcctggttggctcatttaattttttttttttttttgagaccgagtcactcttgtcacccaggctggagtgcagtggcgcgatctcggctcactgcaagctccacctcctgggttcatgccattctcctgcttcagcctcctgagtagctgggactacaggcgcccgccaccatgcccagctaattttttgtatttttatagaggcgcagtttcaccgtgttagccaagatggtctcgatctcctgacctcgtgatctgccctcctcagcctcccaggtgctgggattataggcgtgagccaccgcgcgcaccccatttaattattttttatgttataaaatttaatatggaaagtgagaatttgaaccttcaccatccaccactctattcaggtaaaacaatgaatgagccaccttagcaggagcagatttttcccagaagctgctgcctcttcctgaggcagaaaattggattactaaggctcaaaactaaaagagatgtcagcattgttggatagaaatgtcacctatatgggatttgcctgttttaataactttgtaaggaattcttgctcttctaggggtgcctggcgcaaccgtgggcaagttactgctcctctttaaacctcgtggtggttattgaaacagatttattagaaggagagggtaggtgcagagctggagagccatgggtgaggcagcttgtgacctgcctagcagccgctgaccacctctccaacagaagcctagtcctgttcagagcagcactgtcactgcaagtccagccccctttgccaggggctccattccacccctttcctgcagggaggggtgccatgagtcttgcttttggctcatacaggagagagggaaggctgccaggcactgcttgtatccctgctgataagaggagggagtcactccaggaataagacaaaaggagaggaggaggccatcacctctggcctcttccatcgtacacttcctgtctctggtttaatcatgatgcatggagctacaacagccatcttaggtccccgaggtgcccagcatcacgtaaaacatcgatatgctaagaagaacaaaaagagcccaatctctgatgttattgagctcctgcatgaactctggacctgcctgcctcagacttctgtgaaagaataaaatttctttttgcctaaaaaaaaaaaaaaaaaaaaaaaaaaa

SEQ ID NO: 364 - DNA, 4368 bp, Homo sapiens
cgaaatgagagcaaaaagggagagagcaggaaagcgagcacaggcgagtacagtatacaaagtgttttgagtttctgactggcgtgccggaaagatcatgttagcacacccagaaactccacacgatgcagaccccagaggtaccagcagaaaggtcccctcgtagacggagtatctcagggaccagtacatcagagaaacccaactccatggacactgcaaatacctcacccttcaaagtaccaggattcttcagcaagcgcctgaaaggctccatcaagaggaccaaaagccagtcaaagcttgacagaaacacgagctttcggcttccatcccttcgcagtacagatgacaggtctcgtgggctgcctaaactaaaagagtcacgttcccatgaatccttgctgagcccatgcagcacagtggaatgtctggatcttggtagaggggaacctgtatcagtgaaaccacttcatagtagcatccttggacaagacttctgctttgaggttacctacttaagtggaagtaaatgcttcagctgtaattctgcttctgagagagacaagtggatggaaaaccttcgcaggacagttcaacctaataaggacaattgcaggcgagctgaaaatgttcttcgtttatggatcattgaagccaaggaccttgcccctaaaaagaaatatttctgcgaactgtgccttgatgataccctctttgctcgtacaaccagcaagaccaaagcagacaatattttctggggcgaacattttgaattcttcagccttccacctcttcatagtatcacagttcacatttacaaggatgtggaaaaaaagaaaaaaaaggacaagaataattatgtagggctagtcaacatccccactgccagtgtgactggtcgccaatttgtagaaaagtggtatccagtgagtacacctacacccaacaaaggaaagacaggaggaccttctattcggattaaatcacgtttccaaactatcaccattctgcctatggagcaatacaaagaatttgcagaatttgtcaccagcaactacaccatgctgtgttctgtccttgagccagtaattagtgtgagaaataaagaggagttggcttgtgccttagtgcacattcttcaaagtactggcagagccaaggattttctgactgacttggtgatgtctgaggtggatcgttgtggagagcatgatgtcttgatcttcagagagaacactattgccaccaaatccattgaggaatacctcaagttggtgggacaacagtatcttcatgacgcactgggggagtttatcaaagctttgtatgagtccgatgagaactgtgaagtggatcccagcaaatgttcatctagtgaactgatagaccatcagagcaacctgaaaatgtgctgtgagctggctttctgcaagatcatcaactcttactgtgttttccctcgtgagttgaaagaagtgtttgcatcatggaagcagcagtgcctgaaccgtggcaagcaagacatcagcgagaggctcatcagtgcctcattatttctccgttttctgtgtccagccattatgtctcccagtcttttcaaccttatgcaggagtatcctgatgaccgcacatctcggactctaactcttattgccaaggtcattcagaacctggccaactttgccaagtttggtaacaaagaggaatacatggcattcatgaatgattttttagaacatgaatggggtggaatgaagcgctttcttttggagatctctaatccagacaccatctcaaacaccccaggctttgatggttacattgatctgggccgagagctttcagttttgcattccttactgtgggaagtagtttcccaacttgataagggtgaaaattccttcctacaggcgaccgtggcaaaattggggcctctccctcgtgttcttgctgatattaccaagtcattgactaatcctacgccaatacaacagcaactgagacgcttcactgaacataactccagtccaaatgtcagtggaagcctctcctctgggctgcagaaaatatttgaagaccccactgacagtgatttgcataaactaaaatctccaagccaggacaacacagacagctacttcagagggaaaacattattgctggttcagcaagcctcctctcagagcatgacttattctgaaaaggatgaaagggaaagtagccttcctaatggtcggagcgtctccctcatggacctccaggacactcatgctgctcaagtggagcatgcatctgtcatgcttgatgtgcctatacgcttgaccggaagccagctttccataacccaggtggccagcatcaaacagctgcgggaaacccagagcactccccaaagtgcaccccaagtgagaaggcccctgcacccagccttgaaccagccaggtggccttcagcccttgtcgttccagaaccctgtctatcacctcaataacccaattccagcaatgccaaaggcctctatagattccagtttggagaacctaagcactgccagttccagaagccaaagtaacagtgaagacttcaagctcagtggacccagcaatagcagcatggaagatttcactaaacgtagcactcagagtgaggacttctccaggcggcacacggtgccagatagacacatacctcttgctttgccacgacaaaatagtactgggcaggcccagatccgaaaagtggaccagggtgggttaggtgcccgagccaaagccccaccatccctgccacacagtgcttctttacgtagcaccgggagcatgtcagtggtgtccgcagccctggtggccgaacctgtgcagaatgggagccggtcccggcagcagtcctcttcctccagagagagccctgttcccaaagttagagcaatccagagacaacagacacagcaggttcagtcacctgtggactctgccacaatgtccccagtagagaggacagcagcctgggttctgaacaatgggcagtatgaagaggatgtggaagaaactgagcaaaatctagatgaagccaagcatgctgagaagtatgaacaagaaattactaaactgaaggagcgcctgagagtttccagccggcgactggaggaatatgaacgccgcttgctggtgcaggagcagcagatgcagaagctgctgctggaatacaaggcccgactggaggacagcgaggagcggctccgaagacagcaggaagaaaaagatagccagatgaaaagcatcatcagcaggctaatggctgtggaagaggaactgaagaaggatcatgctgagatgcaagcagttattgatgcaaagcagaaaataattgatgcacaggaaaaacggatcgtgtccctggattcagccaacaccagactgatgagcgcgctgacccaagtgaaggagcggtacagcatgcaggtccgcaatggcatctcccccaccaaccccaccaagctttccatcacggagaatggtgaattcaaaaacagcagctgctgacgggctttgtctgtggaaggagacagaaggaaattgacccactctcctatctccagacctttacctagcccctccaggtttacagaatgttgctacttcacaatggcgatgtggtgagaaactcctgaatgaagaaaggaaccttgtctttcagggcataaggcggcgacttccaaggtcaatgcttttcccccacatctctatgtacatagggaacttagttctgggccatgtacagaaaatatcactgtaatataccaaaaggaagttaataatgtagattacctttttgattattgctatttttattattgttttcctcttgttgaaagcactgcagttgttacaggaagtaaagtaggaatgttgtgtgagcgagacatgagcctgtagttcagtaggtagagaccaagcatctatctgatagaacacatggagtgcaataggacattgtgagaaggatttttcagggattcatctactagtttaaaaaccccactctggccctcttgtcctttcagaaaacatgcaaataccaagatccatacaaaacaataatttattccactgatcaaccaagactggttctggttggacagctaatctgatttggggattcactgtttcagaggacacagacaaaagctgttgcatcaaaactggactttaggagtaatttctattgaactcctgtcaatatgtttatttcctctgtctacagcagatgggagtcttctcttttagacaggggctttttgtttttaaccccaattgtaataaagggtgttctttttcctctttagaaaaaaaaaaaaaaaaaaaa

SEQ ID NO: 365 - DNA, 2077 bp, Homo sapiens
agagcaaagaaaaatccaattgcctgcacaataaaaagttgtcagagaagaaagtgaagtctcccctgcatttattttctactttgcgcaggtcgccaagttatcctccccctggttgtggcaaaagcaaatccaaactgaaatctgagcaggacggaatctccaaaacgcataagctgctgcggaggacttgttccagcacagttaagactgatgatgtgtgtgtcacaaagtcacacaggacctttggccgctccttgtccagcgatcccagggcggagcaggctatgacagcaattaaatcgcacaaacttttgaaccgtccttgccctgcagctgttaagtcagaggaatgcctaactctaaagtcgcatagactattgactcgatcttgttctggagatccacgatgtgagcacaacacaaacttgaagccccataaactgttaagcaggtcttactctagtaatctcagaatggaagaattatatggactgaaaaatcacaaattgctcagcaagtcctactccagtgcccccaagtcatccaaaactgagcttttcaaggaacctaacgcagagggcaggaggctctctcttacctcagggcttattggtatcctaacaccatcttcatcttcatcttctcagcttgctccaaatggtgcaaaatgcattccagtacgagaccgtggcttcctggtgcagacaattgagtttgctgaacagcggatccctgtattaaatgaatattgtgtggtttgtgatgagccacatgtgtttcaaaatggccctatgcttaggcctaccgtatgtgaacgggagctgtgtgtgtttgcttttcaaaccctgggagtaatgaatgaagctgctgatgaaatagcaactggagctcaggtggtagatctactagtatccatgtgtaggtctgcgttggaatctcctagaaaagttgtgattttcgagccatatccttctgtggtagatcctaatgatcctcagatgttggccttcaaccccaggaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaaaggacagcaatcccaattcctgcaaagccgtaacttaaaatgcatagccttatgtgaagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtgatcaaactgctactggttaaaggaccaccatttaattaacatgattcgaaagccttcctcgggttcaaagctggattttgaactgaagaagattataaaattatttattgttattataaacaaaattaaccctttgaatactgattttttttcttagtatttctaagtatctcattaaatacctaaaatggtataagatttatcaattgtagggttatggaatctagtaataaaatttcaacagcacttaaactgaagtttgggttgctcatacaataaacagattgaaaaaaaaaaaaaaaaa

SEQ ID NO: 366 - DNA, 1442 bp, Homo sapiens
  modified_base (5)..(5): a, c, g, or t
  modified_base (11)..(11): a, c, g, or t
  modified_base (15)..(16): a, c, g, or t
  modified_base (18)..(18): a, c, g, or t
  modified_base (20)..(21): a, c, g, or t
  modified_base (24)..(24): a, c, g, or t
  modified_base (26)..(28): a, c, g, or t
  modified_base (30)..(33): a, c, g, or t
  modified_base (35)..(35): a, c, g, or t
  modified_base (37)..(46): a, c, g, or t
  modified_base (49)..(50): a, c, g, or t
  modified_base (55)..(55): a, c, g, or t
  modified_base (195)..(195): a, c, g, or t
  modified_base (210)..(210): a, c, g, or t
  modified_base (219)..(219): a, c, g, or t
  modified_base (223)..(223): a, c, g, or t
  modified_base (310)..(310): a, c, g, or t
  modified_base (313)..(313): a, c, g, or t
  modified_base (331)..(333): a, c, g, or t
  modified_base (410)..(410): a, c, g, or t
  modified_base (412)..(412): a, c, g, or t
  modified_base (460)..(460): a, c, g, or t
  modified_base (464)..(464): a, c, g, or t
  modified_base (481)..(481): a, c, g, or t
  modified_base (483)..(484): a, c, g, or t
  modified_base (512)..(512): a, c, g, or t
  modified_base (520)..(520): a, c, g, or t
  modified_base (524)..(524): a, c, g, or t
  modified_base (599)..(599): a, c, g, or t
  modified_base (610)..(610): a, c, g, or t
  modified_base (616)..(617): a, c, g, or t
  modified_base (621)..(622): a, c, g, or t
  modified_base (625)..(625): a, c, g, or t
  modified_base (636)..(636): a, c, g, or t
  modified_base (644)..(644): a, c, g, or t
  modified_base (652)..(652): a, c, g, or t
  modified_base (661)..(661): a, c, g, or t
  modified_base (670)..(670): a, c, g, or t
  modified_base (676)..(676): a, c, g, or t
  modified_base (682)..(683): a, c, g, or t
  modified_base (693)..(693): a, c, g, or t
  modified_base (705)..(705): a, c, g, or t
  modified_base (715)..(715): a, c, g, or t
  modified_base (1332)..(1332): a, c, g, or t
  modified_base (1364)..(1364): a, c, g, or t
  modified_base (1369)..(1373): a, c, g, or t
  modified_base (1376)..(1377): a, c, g, or t
  modified_base (1379)..(1379): a, c, g, or t
  modified_base (1381)..(1381): a, c, g, or t
  modified_base (1383)..(1383): a, c, g, or t
  modified_base (1385)..(1385): a, c, g, or t
  modified_base (1387)..(1387): a, c, g, or t
  modified_base (1389)..(1389): a, c, g, or t
  modified_base (1391)..(1391): a, c, g, or t
ggggngaagcngggnngncnnggngnnncnnnngngnnnnnnnnnnggnnggggngtgagaggttttctcgctctagggagattcttcaagcaatcactatgtcaacagacacaggtgtttcccttccttcatatgaggaagatcagggatcaaaactcattcgaaaagctaaagaggcaccattcgtacccgtnggaatagcgggtttngcagcaatntgtngcatatggattatataaactgaagagcaggggaaatactaaaatgtccattcatctgatccacatgcgtgtggcagcccaaggcttngtngtaggagcaatgactgtnnngtatgggctattccatgtatcgggaattctgggcaaaacctaagccttagaagaagagatgctgtcttggtcttgtngnaggagcttgctttagttagatgtcttattattaaagttacctattatntgtntggaaataaactaattntnnatgggtttagatggtaacatggcatttntgaatatntggnttcctttcttgcaggcttgatttgcttggtgaccgaattactagtgactagtttactaactaggtcattcaaggnaagtcaagttnaacttnnaaannatngtcacctaaantgcacttngatggtgnttgaaatgntccaccttncttaanattttnnaagatgaacnttagttctaaangaagataacnaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgtnaacatggtatatgtattgttattaaagtaagngaccnnnnncannanananananananacacacaccctgagagagagaaagagagagagatcactaaagagagagaac

SEQ ID NO: 367 - DNA, 3208 bp, Homo sapiens
  modified_base (145)..(145): a, c, g, or t
  modified_base (2136)..(2136): a, c, g, or t
  modified_base (2848)..(2848): a, c, g, or t
  modified_base (3014)..(3015): a, c, g, or t
  modified_base (3167)..(3167): a, c, g, or t
  modified_base (3199)..(3199): a, c, g, or t
aaaactcttctcagacccgggagcgtccgggacgcggagcccggagctggggcgacgaggcgattgcgggggcctgggctagctgctggctaccaatattctactttctgtctctatgtatgtgactaccctggttacctcatanaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaagaacaaaaagaagaaaaacaaaccgaaacctgccgcagaaccaagtaacggcatcccagattccagtaaatcagtttccattcaagaggaacagtctgcgccttcctcagagaaaggtggtatgaatggctaccatgtcaatggtgccatcaatgacactgagtctgtggactcactcagtgaaggtttggagacactttcaatagatgccagagaattggaggatcccgagtctgccatgctagatacgctggatagaacaggatccatgctgcagaatggtgtctctgattttgagaccaagtctttgactatgcactctattcacaattctcaacaacccaggaatgctgccaaatctctctcaagacctaccacagaaactcagttttcaaatatggggatggaagatgttcccctcgccaccagtaaaaagctaagttccaatattgaaaaatctgtaaaagacctccagcgctgcacagtgtctcttgcacggtatcgagttgtagttaaagaagagatggatgcctccattaagaaaatgaaacaagcctttgctgaattggagagctgtttaatggatcgagaagtggcgttgcttgctgaaatggacaaagtgaaagctgaagcaatggaaattttgctcagccgacaaaagaaggctgaacttctaaagaagatgactcatgtggctgttcaaatgtcagagcagcaattggttgagctcagagctgatatcaagcactttgttagtgaacgtaaatatgatgaggatctgggacgagtagcccggttcacctgtgatgtagagaccctaaagaagagcattgattcatttggacaagtgtctcatccaaagaacagctattcgaccagatcccgatgtagctcagttacatctgtgtccttgagtagcccaagtgatgcctctgctgcttcctcttccacctgtgcctctcctcccagccttacaagtgctaacaagaaaaactttgcaccgggagagactcctgcagccatagcaaactccagtggccagccctaccagccacttcgggaggtattgccagggaacagacgaggaggacagggctataggccacaaggccaaaagtccaatgaccccatgaaccaagggcggcatgacagtatgggtcgttacagaaacagctcgtggtattcatctggttccaggtatcagagtgctccatctcaggcaccaggaaacaccattgaaagaggccagactcactctgcagggaccaatggaactggagtcagcatggagcccagccctcccacgccttcattcaaaaaggggctcccccagcgcaaacccaggacctctcagactgaagccgtgaactcttgagagaaaatccagttggcctctctcctctatccacacaattcaacttgataactggactttaggaaacttacagttagatgtaataacaaaaagaagtttatgcgtatcantttttgtgccattctaagtatttttggtttcttgtctccttatttcctctttaccatttttggaggggaagctattttttttccttgatctttcccagtgatatggattgaatctggttggtcatttccaccaggaatcagaggcagctgttaccaggtttcggccttccagttgatccctccactgtccaggctgtctcaggaggaggtgaatcagagctagtctgtcacctttccaatctaagccgaagccacaggtgcctgacaggttcccttctaacaactatttgaccaagagaggcaatcagggggttgtatactgcactggattcgccagagaagggaaaatttaattagtgaaaaggaaagaacactaggaaacatttgagaacctgcctctatcccagaatgtgctggagatttgacactcaaatcagtgtttagtcttctgcttggcaccatagcttaacctgcagtttcttcaaaatgcccaatgccttgtttcctattaccttagattgcaaaccagtctagggaagtctatgagaaagtagcatttaattaaagtttaaaaaaaaaaaggttgggcgttgtggctcatgcctgtaatcccagcactttgggaggctgaggcgggtggatcactaggtcaggagttcaagaccagcctggccaacatggtgaaaccctgtctgtactaaaaatacaaaanttagctgagcatggtggcgtgtgcctgtaatctcagctactcaggaggctgaggcaggagaatcgcttgaacccaggaggcggaggctgcagtgagctgagattgtgccactgcactccagcctgggagacagagcaagactcagtctcaaaaaaaaaaaaaaaanngcatttttctgttttaatgtttggagacttttttttttgttctctccctttcctgaaccctattctgatcctgaaccaaatttatagcaatataattagtgttaatctaaggcattactcatcaaaaaaattgctgcagtctttacagttgnataaataaaaacaactgcataaatatgcccanaaaaaaaaa

SEQ ID NO: 368 - DNA, 3786 bp, Homo sapiens
  modified_base (238)..(238): a, c, g, or t
  modified_base (260)..(260): a, c, g, or t
  modified_base (2002)..(2002): a, c, g, or t
  modified_base (2148)..(2148): a, c, g, or t
  modified_base (2951)..(2951): a, c, g, or t
  modified_base (2954)..(2954): a, c, g, or t
  modified_base (2956)..(2956): a, c, g, or t
  modified_base (3003)..(3003): a, c, g, or t
  modified_base (3005)..(3007): a, c, g, or t
  modified_base (3010)..(3010): a, c, g, or t
  modified_base (3019)..(3019): a, c, g, or t
  modified_base (3021)..(3021): a, c, g, or t
  modified_base (3029)..(3030): a, c, g, or t
  modified_base (3035)..(3035): a, c, g, or t
  modified_base (3037)..(3037): a, c, g, or t
  modified_base (3051)..(3051): a, c, g, or t
  modified_base (3053)..(3053): a, c, g, or t
  modified_base (3078)..(3078): a, c, g, or t
  modified_base (3089)..(3089): a, c, g, or t
  modified_base (3131)..(3131): a, c, g, or t
  modified_base (3166)..(3166): a, c, g, or t
  modified_base (3598)..(3598): a, c, g, or t
  modified_base (3648)..(3652): a, c, g, or t
  modified_base (3758)..(3758): a, c, g, or t
aaaaatgtgtgtttgtgggtgaaatggctgcgcaggtcggagcggtgcgcgtagtacgggcggtggcggcgcaggaggagccggacaaagaggggaaggagaaacctcatgctggggtctccccgcggggagttaaacggcagcgccgatctagcagtggggggtctcaggagaagcgggggcggccgagccaggagccccctctcgctccccctcaccggcggcgtcgcagccgccnacatcctgggccgctgccgccnacgaatgcagccccaactgtcccaggccctgttgagcctcttctcctgccgcctccgccgccaccttcgctggcacccgccgggcccgctgtcgctgcccctctcccggccccaagcacctcggccctcttcaccttctcgcctctgacggtgagcgcggccgggcccaagcataagggccacaaggagcggcacaagcaccatcaccaccgcggccccgatggtgatcccagctcctgcggaaccgatctcaagcacaaggacaagcaggaaaacggcgagaggactggaggggtgcctctgatcaaagcccccaagagagaaacaccagatgaaaatggtaaaacccagagagccgatgattttgtcttgaagaaaataaagaagaaaaagaaaaagaaacaccgagaagacatgcgaggaagacgccttaaaatgtacaataaggaagtacaaaccgtctgtgctggcctgacccgcatcagtaaagaaattctcacccaaggacaaataaatagcacttcaggacttaataaggagtccttcaggtatctgaaagatgaacagctgtgccgattaaatttgggtatgcaagaatatcgggtaccccagggagtacaaacaccttttatgactcaccaggaacattctattcgtagaaatttcttaaaaacaggtactaaatttagcaactttattcatgaggaacaccagtccaatggtggtgctcttgtccttcatgcttacatggatgaactctcatttttgtctccaatggagatggagagattttctgaggagtttcttgctttgacattcagtgaaaatgagaaaaatgctgcttactatgctttagcaatagtgcatggagcggctgcttatctcccagacttcttggactactttgcttttaatttccccaacactccagtgaaaatggaaattctgggcaagaaagatattgaaacaaccaccatttcaaattttcacactcaggtcaacaggacatactgctgtggcacctaccgagcaggtcctatgcggcagataagtctcgttggagcagtagatgaagaagttggtgattatttcccagagttccttgatatgttagaagaatcaccatttctgaaaatgactttgccctggggtacactttctagcctccgactccagtgtaggtcccagagtgatgatgggcctataatgtgggtaaggccaggagaacagatgatccctacagcagatatgccaaagtcacccttcaaaagacgacgatcaatgaatgaaataaaaaatctccagtacctacctcggaccagtgaaccccgcgaagttctctttgaagataggactagagctcatgctgatcatgtcggtcaggggtttgactggcagagtacggctgctgttggagttttgaaagctgtacaatttggtgaatggagtgaccaacctcgcataaccaaagatgtgatttgttttcatgctgaggattttactgatgttgtacaaagacttcagttagatcttcatgaacctccagtttcccagtgcgtacagtgggtagatgaagctaaactaaaccaaatgaggcgggaaggcattcgttatgctagaattcagctttgcgacaatgatatctacttcatccctagaaatgtcattcatcagttcaaaacagtttcggcggtgtgcagcttagcctggcatataaggcttaaacagtaccaccctgttgntggaagccactcaaaacacagaaagcaattctaacatggactgtggtttaactggaaagcgagaattagaagttgactcccaatgtgtgaggataaaaactgaatctgaagaagcatgcacagagattcagctgttaacaactgcntcatcatctttcccacctgcatcagaacttaatctacagcaagatcagaagactcagcctattccagttttaaaagtggaaagtagactggactctgaccagcaacacaatctgcaagaacattcaaccacttctgtgtgatatgtacatattcaaacacattttttaacttttttaaattttgatgtgaagttatagttttataactggcttaagttaagttttattggagaaatcttgcctataattctataaagagaaatgacattccacaaatgtcaagcatatcttttttacacagattatgcaaagttaagagttgtatcttatcccgttagtacagtatgtaatagtgggtctgctgctactttctgttttaaggtgtgaggtaacaattcaatctcttcttcaaatcaaaatgagaattctctggaataacagattcttgtttggtaaattattcacttcccttaattttatcttgccttgtctcttgccatatttgctgtttttatggataaataagatttatggtttagtacttgtgtctttatggcacaggttcaatttctacagtgaaaatggcataggttgcaggaaagaatttctgcatctggtacatgggcaagtaagttatttagttctaaccacaaataacaagtagtttccaaggaaatttcagtggctctctggtttcttaacaaaagagaaagcacagcactttctgatccaaactgtcttttttttgtatctgttatttaaagcccagtggatatttcaattaaaaaaaaaatctaaagatnaanantccttggtcattcattatccatggctcattaatctcttctagaatanannntanctgttgaananattttggnnaaaananataatgttgacatnanactctattgttctgcttcctggcancctcacatttngtggggataattttgcttcctaaactgatcacaactattaancttagagaataataatagtctttctgatgaggctnccatattttgagcatcaatcttatgataaactattcttgtcacttggcatcaacctcttcatgataaatatctactactgagacacttcaattcacagttttaactggtgaatacctgggtttatttactattactctgtgttgctattttctaagaaagaatacagcactagacttcatcctagagtttcaggtaggctaatgcttagtgcctgagtatttaaattttcttttcaaacaggcacagttcacattgctagtatggtcctaactttctgttattttagaatgttaacatgattcacattatactttctcttagttaataatacagtaggccttttgtttattaatggaagagtactccccacacctaagaccagattcttatatctccctggttacagtgcaatttggagatttttttttttncctggatggtaagatttgaaatatttacattaacataggcaaaaaaaaannnnnttttgaaatatcaaatatgaatcttctctaaaatattctgaaataggttaaatcttatataaatattactttgtgcaatatagctgtgtagttaaatgcatattancaaagtatagaggtcactgtgtaaaccg

SEQ ID NO: 369 - DNA, 1067 bp, Homo sapiens
tcgaccggctgcgagaagacgacagaagggggccgcgggacatccacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagccggacacaaaatgaaggccaccccaaatggtttgttcttggtgttgggcaagtcataaaaggcctagacattgctatgacagatatgtgccctggagaaaagcgaaaagtagttatacccccttcatttgcatacggaaaggaaggctatggtagtcttgaagaagtctttcttctgcaaaatatccttgtctcatgtcacagaacaaccctgcatgtcttgaaatgcatgtacttgttagtgcttaataacaatacatgcgcagaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatagcatatttgtatttctactttttttttttagctatttactgtactttatgtataaaacaaagtcacttttctccaagttgtatttgctatttttcccctatgagaagatattttgatctccccaatacattgattttggtataataaatgtgaggctgttttgcaaacttaaaaaaaaaaaaaaaaaaaaaaa

SEQ ID NO: 370 - DNA, 4245 bp, Homo sapiens
  modified_base (18)..(19): a, c, g, or t
  modified_base (21)..(22): a, c, g, or t
  modified_base (25)..(28): a, c, g, or t
  modified_base (41)..(41): a, c, g, or t
  modified_base (43)..(43): a, c, g, or t
  modified_base (45)..(45): a, c, g, or t
  modified_base (60)..(60): a, c, g, or t
  modified_base (548)..(548): a, c, g, or t
  modified_base (551)..(552): a, c, g, or t
  modified_base (555)..(555): a, c, g, or t
  modified_base (1068)..(1068): a, c, g, or t
  modified_base (1070)..(1071): a, c, g, or t
  modified_base (1141)..(1141): a, c, g, or t
  modified_base (1160)..(1160): a, c, g, or t
  modified_base (1168)..(1168): a, c, g, or t
  modified_base (1172)..(1172): a, c, g, or t
  modified_base (1188)..(1188): a, c, g, or t
  modified_base (1214)..(1214): a, c, g, or t
  modified_base (1230)..(1230): a, c, g, or t
  modified_base (1244)..(1244): a, c, g, or t
  modified_base (1246)..(1248): a, c, g, or t
  modified_base (1250)..(1254): a, c, g, or t
  modified_base (1256)..(1256): a, c, g, or t
  modified_base (1258)..(1258): a, c, g, or t
  modified_base (1483)..(1484): a, c, g, or t
  modified_base (1891)..(1891): a, c, g, or t
  modified_base (2555)..(2555): a, c, g, or t
  modified_base (3040)..(3040): a, c, g, or t
  modified_base (3181)..(3181): a, c, g, or t
  modified_base (3595)..(3595): a, c, g, or t
  modified_base (3670)..(3670): a, c, g, or t
acagaatttacgcacccnngnnttnnnnggagcctagcggntntncccgcgtccaagatnggcggcagaagcagctggtgggaaatacagaagcacagtcagcaaaagcaaagacccctcggggctgctcatctctgtgatcaggactctgtctactagtgacgatgtcgaagacagggaaaatgaaaagggtcgccttgaagaagcctacgagaaatgtgaccgtgacctggatgaattgattgtacagcactacacagaattgacgacagccattcgcacataccagagcatcacagagcgcatcactaactcccgaaataaaataaagcaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtgtcagcagttgagtctntgnnggnccccctgctccaggtggaaggactgagtgaccttcgactagagcttcacagcaagaagatgaaccttcacttggttctcatagatgaactacaccggcacctgtacatcaaatcgactagccgagttgtgcagcgtaacaaggaaaaagggaaaatcagctccctcgtgaaagatgcttctgttcctctgattgatgttacaaacctccctactcctcgaaaattccttgatacctctcactattctactgctggaagctcaagtgtgagggagataaatctgcaggacatcaaggaagatttagaattggatccagaggaaaacagcaccctgtttatgggtatcctcattaagggcttggcgaaactgaagaagatcccagaaacagttaaggcaatcatagagcgcttggagcaggagttgaagcaaattgtgaagaggtctacaacccaggtggcagacagtggctatcagcggggggagaacgttactgtggagaaccaaccaaggtngnntctagaactgctggagttactgtttgacaagtttaatgctgtagccgctgcacactctgtggtcctgggnatacctgcaggacactgtnagtgactnccantgactcagcaggaagntatcaaactgtatgatatggcagatntatgggtgaagatccnagatgttctacagntnnnannnnntnantacttggatatgaaaaatactcgtacggcctctgaaccatcagctcaactaagctatgccagcactggacgagagtttgcagccttttttgccaagaagaaacctcaaaggccaaaaaattctcttttcaagttcgaatcgtcctcccatgccatcagtatgagcgcctatctgcgagaacagagaagggagctctatagtcggagtggagaactgcaagggggnnctgatgacaacttaattgaaggtggaggaacaaaatttgtctgcaaacctggagccagaaacattaccgtcatattccacccattactaagatttattcaggagattgagcatgctctgggtcttggcccagccaaacagtgtcctcttcgagagtttctcaccgtgtacatcaaaaacatctttctcaatcaagtcttggctgagatcaacaaggagattgaaggagtcactaaaacatctgaccctttgaagattctggccaacgcagacaccatgaaggtgctgggagtgcagcggcctctcctacagagcacaatcattgtggagaagacagttcaagacctcctgaacctgatgcatgacttgagtgcatattcagatcaattcctcaacatggtgtgcgtnaagctccaggagtacaaggacacctgcactgcagcttacaggggtattgtccagtcagaagaaaaacttgtcatcagtgcatcctgggcaaaagatgatgatatcagcagactcttgaaatctctaccaaactggatgaatatggctcaacccaaacagctgaggccaaaaagagaggaggaagaagatttcataagggcagcttttggcaaggagtctgaagttcttattgggaacctgggtgataaattaatccctccacaagacatccttcgtgacgtcagtgacctcaaagccttggccaacatgcatgaaagcctggaatggttggcaagtcgaacaaagtcagctttctccaatctttctacatcccagatgctttctcctgctcaagacagccacacgaacacggatctccccccagtgtcagagcagatcatgcagactctcagtgaacttgccaaatcgttccaggatatggctgaccgctgcttgcttgtcttacatctggaagtgagggttcactgtttccactatcttatccctcttgcaaaggaggggaactatgccattgtggctaatgtggaaagtatggattatgaccccctggtggtcaagctcaacaaagatatcagcgccattgaagaggccatgagcgccagcnttcagcagcacaagttccagtatatcttcgaaggcctgggccacctgatctcctgcatcctcattaatggtgcccagtacttcaggcgcatcagtgagtctggcatcaagaaaatgtgtaggaacatttttgttcttcagcagaatttgaccaacatcaccatgtcgcgggaggcagacctggactttgcaaggcagtactacgagatgctttacaacacagctgacgagctcctgaacctggtggtggaccagggtgtgaagtacacggagctggagtacatccacgctctgaccctgctgcaccgcagccaaactggggtgggggaactgaccacccagaacacgaggctgcagaggctcaaagagatcatctgcgagcaggctgccatcaagcaagccaccaaggacaagaagataactaccgtttagcagggcgtactgcggttggtgacgggggtcccctcagtcacactcacttttttnccttggtatgttattgagtatattctgagcttagttttctctacagtgatactttagtggagaggaggtgtaaggattctttctctctggttttggcttttcatataaatgctaaaggaaggcgacagtacagagtgtttnggttgaacaactactttaatgcagtcaaatctaacgggactagggtgggatagggaggaaggtggtatcaaattgttggactctgaaaaacaagtggatggattactaatatttgatttattactcaatatatatataattccagccttggaaagtaggaaagtaggctgctacctaacttttagtcccttccaaaaccatttagtagggttctattacataaacagtagggtttttcctctcctgaccttatccgtttacagttcaatgaaataagtgtatgtgcattgctgtctgtctctattgccaaaatcaaataaatggcttctcagctgctgtttacaacaaacttccctaaccaaaacagaacctctaatttagggctaggaatagaagtcttttgatcccagtccntgggacagttttgtatgctgtatcttgtacacaggttgtaggttggtttattgccattttgttttatttctgctntataaaaaccaagagccagacaattagacaactatggaggaatgaaaggcaattcaaacatctgcttgattcccgccccgccacccctaatttctgagagaataatggttagagaacattgcatctcacttgaaacatcctttgggggtaaatgattcttaggtgctcacttggtctgagctcagctgaatgcagggaagatgggacagagtgacatttctcctctgtgcggcctccagctgagcctgtctctgaattgttccctcccccgcaatgtgggcacttaccatgttcctggcacactggacctcaccatgtcccccggtcaccagtcctcttgctgcccatggttcataggtcatagaaggcagcaatgcactgactgggccacatcttgaaaactcgtggaaagggaaaggggaggagatgggactttgaccacacacagtgatgcctcacaccctgaaggtgggggattttgtacctgtttgtacaactttggtcttgatgggaaaaatggagaattaaaaagtgttttgagaagcttaaaaaaaaaaaaaaaaaaaaaaaaaaaa

SEQ ID NO: 371 - DNA, 2386 bp, Homo sapiens
  modified_base (42)..(42): a, c, g, or t
  modified_base (578)..(578): a, c, g, or t
  modified_base (852)..(852): a, c, g, or t
  modified_base (952)..(952): a, c, g, or t
  modified_base (961)..(961): a, c, g, or t
  modified_base (981)..(982): a, c, g, or t
  modified_base (1477)..(1478): a, c, g, or t
  modified_base (1905)..(1905): a, c, g, or t
  modified_base (1920)..(1920): a, c, g, or t
  modified_base (1944)..(1944): a, c, g, or t
  modified_base (1952)..(1952): a, c, g, or t
  modified_base (2091)..(2091): a, c, g, or t
tttttttttttttttttttttttttttttttttttttttttnttcattcaagaagtatttattgataggtgctaggcaagatacaaagatgactcagacacagatcctgcccataaggagcttacagtctaataggggagagagaacacatacatggaatacatggtcagaactatgtttcagtaagatgaatctaacattgtgtataaagtaggctggagtaagaggttaagtgaagctgagagactactgaaattacataggtgaggaagaaagacgggaaagacttgaggtagaactgacaggacttagctgaagactggatgtggggaataacaaaaatggaagcagatgactcagactttagcatggatgatgtcatgaactgaaagaaggaacaagtttttgcaaagaaatgaaaatttcatataaaattcttctgcatagaaacaaactgtctgggatatactaggcacaatcaggaagaaatggctagttacccagaccaatggaagcacctcaaactggccagtgacttcctcccccttatatatccatccccccaaatttcccaacanttttctccactgaaatggtatagtgcctaaaatttattaaattcaaggtctatctccagacatggcctcccttgggaatgaaaacagaaatatattaagttattcaactcagtaagtttcatctaaagactctagttatgagtcactgtaccttctggtggaatacagagatgaactccctagtccttatcttctaggagcttacagtctagtaaagtagtaaaacagataatgtaattctaattctagactgaaggggtaagttatgaactangagaaagacaaagtgctctagaacagtttcagaaatgaaggttggaacaggacctcaaacaagagggaaaatgtggaaagtagatgagaatggatttgtntcctcactnccaaattctggacagatcanncccaaaacggggctactccccattcctgttgaaattttttcttaggaaaaaatatagctcttgtactgatcttttaaaaaattacttacatggcaagagatcagaggaaaggggggattgtagatctcagtggaccttcggggaagacagaaggcacttgaagccaaggaatcacaatgcctggcttatcgggaggaccctcagtgttttagcaaggctggagcatcacttccatgaagagtgggagaaataactcaaaagtaatattaagaccttgatataaacatggcattgccaggcactaaacagggtacacgcctaagaccaaattgctgccccctaggagcttacagttacaacaatacaaggtggaaaaagcaccacaatgtacagaatgcaaaatgctgaagtatttaggagaaattacagctgagtttcagctattaacacattaggatacccaatagctttctgacagctagtagtaaacccatnnctgaggggagcacaagttaatgtccttagacaacaagccctggtagagctgggccattaaagacagttctaagaaaattgagaaaacaggggtatgaaaactacagaagcaactgggtgaacatacaaaaagtgataccttccctttttctcctgacaaactttaacagggctgcccttcctacagtgaatctaaactgatgatcaccatattacttctaaaagcagatttgggactctactaaccaattctctctgatcctttgtaaaatgaaggggttgtacaagtcacttcctagtcctttccagcactaacattctatgattcaaagaattctgagagtttctctgttccttttggtaataaccaaaatagaagaaaaaaatttaagtctgatgcttctcactcaaaaatataattattttcnatataaatcacaaantgatccctatgctatcagctaaanttttactntccaccctatccttcttcaaaatccatgaattttttaaaaccacatgtcctacaagctaccttagcatgcaccaaatgatttttcaaaaagttttctcatctcctactcccttataccaacttcttggtataatgtcanttaaagggccaaatcagtgtacatccaatcttcataacaaaattttaaaatttaggagaacaactgacatcaaagcatgaggacagtgagtaaccgaagtggtttttgttgttttctaattttttgttttttagagacagggtctcactctgtcacccaggttagagtgcagtggtatgatcataactcactgcagcctccaactcctgggctcaagcaatctcctgcctcagcctcctgagagacggagactataggaatgcgccaccacatctggctcacttttcaattatct

SEQ ID NO: 372 - DNA, 3866 bp, Homo sapiens
  modified_base (8)..(8): a, c, g, or t
  modified_base (71)..(71): a, c, g, or t
  modified_base (109)..(109): a, c, g, or t
  modified_base (945)..(945): a, c, g, or t
  modified_base (952)..(953): a, c, g, or t
  modified_base (1047)..(1047): a, c, g, or t
  modified_base (1372)..(1372): a, c, g, or t
  modified_base (1415)..(1415): a, c, g, or t
  modified_base (1866)..(1866): a, c, g, or t
  modified_base (1984)..(1984): a, c, g, or t
  modified_base (2225)..(2225): a, c, g, or t
  modified_base (2295)..(2295): a, c, g, or t
  modified_base (2520)..(2520): a, c, g, or t
  modified_base (3090)..(3090): a, c, g, or t
  modified_base (3092)..(3099): a, c, g, or t
  modified_base (3225)..(3225): a, c, g, or t
gcgatctntagagaacagcctggatgaagaagtgaccatcgagatcgttctctccagctctggggacgagnactcccagcatggcccgtactgcacagaagagctgggnagccccacagagaagcagcgcagcctccccgcctcccaccggagcagcaccgaggccggaggcgaggtgcagacctccaagaagtcctacgtgtgtccgaactgtgggaaaatcttccgctggagggtcaacttcatccggcatctgcggagccgcagggagcaggagaagccgcacgagtgctcggtgtgcggggagctgttcagcgacagcgaggacctggatgggcacctagagagccacgaggcccagaagccttaccggtgtggtgcctgcgggaagagcttccgcctgaactcccacctgctctcccaccggcggatacacctgcagccggacagactccagccggtggagaagagagagcaggcggcatccgaggacgcggacaagggtcccaaagagccgctggaaaacggcaaggccaaactgagcttccagtgctgtgagtgtgggaaggccttccagcggcacgaccacctggctcggcaccgcagccactttcacctgaaggacaaagcccggcccttccagtgccggtactgcgtcaagagcttcacgcagaactatgacctcctccgccacgagcgcctgcacatgaagcgccgttccaagcaggctctgaactcctactgagcctctccgcctggggcggcctcaccctggctggtgctgccccctcaccttggtactgatcagcgcccccacccaggacataccttccccaggatagagagcacacctccctcctgtccttgctctcaggtagtgagcgttcgggtggtgccatgggagcactctccctcccccaggtaatgaaagagtggccaagtgantgttctnnttctgctgtgccaaaaaacgggggggatgtgccatcaccaggttggacatgccaggtgttctgcgtcttagagacccttggcccatgctccccnaagctcggggagtaaaactgggctatcccccgtcagggcggcaccctggtcaccagccaaacctcagtatactccctcccctccttccctgtctgaacgctaggatctgctcctgaagctccaggatgcctgcacttccactgagaagctgctggcggatgttggactagaggaaagaagaaggcagggtgggactgatgggctcagtggggagcagggccaggcacactgagccagacatgtcatgtctgagccccagattcgtggccatcaggtaggcaggagcaccccgcagatccaagatgatcaggcagcccttttgggntggcctctgtggcaggggtctgcagagctccttcttgaggttnggaaacagtcgtcatacctgttgattttcctgggggccaatcactagggatctggagctcaccaaaaacaaagcttacattttaatttgtgttgcacacctaccccataatgtctttataccccaaagatccttggtaaatgcttgtgggttggaagcggagttgtcatcgtttaaaaggcacttaagtcccttcttccaatctgtcctgtctaggaatgtggagctctgcccccagtgaggggttctcctgtctgggtgagccaagctccagaacagaaccttgcctgacaacacacttgatagatacattagcttggagtgctggtgtgtccaaacactggctggcttagaacaacaggagtgtattccctgacagttctgggaggtgcacgtccaagatcagggtgtcctcagagttggtgccttccgagagctgtgagggagaagcngcttcatgcctttgctggcagttgccattccttggtgtgtggaagcgtcacccagtctctgccttcatctccacatggcactcttgctgtgtgcgtgtctgtctccaaacctcccttngtttaaggacaccagtcatatcggattagagcccatcccaccgactccagtataacctcatctgtatccgcagcaaccgtttaccaataaggtcacattctgaggtactagaggttgggacttcaacatcggaatttgaaagggacagcattcagcccatgactccagataaacgtgaggtatgctatatcattcctaatttacagatgagtcaatacaaacttgagtgagcttgctcacnaattccatcaaaggcagggttcagacccaagtttcagcatttagggcaggtgtcctctgcatggaagaancatactcaatagccgtaaacgctgacaaattccccttcctccctgccttctgatgggggctgggcaggccagctggagctgtgtctcctgctgggattccggactgagagtgacagcaggtagtgaaacctcaagcaatttaaaacatggtattgttcctggaagactggttatgttggctagggtcagcaagagagggcatcaaggctgtagtctagcagtganttaatctgcaagtcaaaccagacgggtattttgtattattcatatgtcacatcctaccaacagacagtaagtcaggcaaggctcctggtgctccttgtcactcacgtaattttcacatcaggaaaactctgggctgggtgcagtggctcacacctgtaatcctagcactttgggaaaccaaggtgggtggattgcctagctcagtgacaccagcctgggccacatggcaaaaccccgtctgtaccaaaaatgcaaaaaattagctgggtgtggtgttgacgtttgcggtcccagctactctggaggctgaggtgggaggattgcttgagtctgggaggcagaagttgcagtaagccgagatcatgccactgcacaagctaggtgacagaatgagactctgtctcaaaaataattaaaaagcctctgccccaaactcgttaaaagattttataaccacaactgctgtttctgtgtagatgcatctgcatgcccaggagcagtaaatgcaataaaatcatttggttatactttgaacacaaaataaacggttgaggcttttactttctaaanannnnnnnncttgtatcaacatagctggaaaagggagaaatccgatttttaaggccaagggaggggaaaattccaagtagaagccaggctctctgtacacgtttaccccacctacctgtgtgctcctacctgtgntgaggattctctctgtagctctaaggtcttgggaaggttattcaccttcctgcttcagacgtctgactcaagagaagaacactgttctacttaccagagtgtttttctgtgtaaaaccacatcatgaaggagaaagcgacaaagggaatgtgaggggctggaagccacagggaggctgtctcttgagtccccaccactgatccagagccaaccaaggcacctcaggaaatggaaggccacattgcctctggatttggaaatcctcctgggtaatgtaactgaaacccaggttgatgccatgcagcaggagcagcagggggaacgtgctctcaggagaggtcggccaaccctccagcccaacacccttcaccacagtggtggaggaggctgcacccaggagatctttgtctcccttttggccactgatacctttggccttatctgacaacagctacccctcgatccttccctcccaccccaggggctgggcagctggctggagctttgtgtccaccttgctctggaggttgagacccccatctgagcaacatcctctctctttgttcctctgatcccttggcatcgtcacaaacccacaggtgcataataaaaacttgctgagtcaaaaaaaaaaaaaaaaa

SEQ ID NO: 373 - DNA, 3450 bp, Homo sapiens
  modified_base (15)..(15): a, c, g, or t
  modified_base (34)..(35): a, c, g, or t
  modified_base (134)..(136): a, c, g, or t
  modified_base (1018)..(1018): a, c, g, or t
  modified_base (1079)..(1079): a, c, g, or t
  modified_base (1357)..(1357): a, c, g, or t
  modified_base (1424)..(1424): a, c, g, or t
  modified_base (1448)..(1448): a, c, g, or t
  modified_base (1838)..(1840): a, c, g, or t
  modified_base (1842)..(1848): a, c, g, or t
  modified_base (2308)..(2308): a, c, g, or t
  modified_base (2325)..(2325): a, c, g, or t
  modified_base (2332)..(2332): a, c, g, or t
  modified_base (2337)..(2337): a, c, g, or t
  modified_base (2347)..(2347): a, c, g, or t
  modified_base (2441)..(2441): a, c, g, or t
  modified_base (2443)..(2443): a, c, g, or t
  modified_base (2452)..(2452): a, c, g, or t
  modified_base (2459)..(2459): a, c, g, or t
  modified_base (2469)..(2469): a, c, g, or t
  modified_base (2502)..(2502): a, c, g, or t
  modified_base (2526)..(2526): a, c, g, or t
  modified_base (2538)..(2538): a, c, g, or t
  modified_base (2824)..(2824): a, c, g, or t
  modified_base (2859)..(2859): a, c, g, or t
  modified_base (2871)..(2871): a, c, g, or t
  modified_base (2873)..(2873): a, c, g, or t
  modified_base (2881)..(2881): a, c, g, or t
  modified_base (2911)..(2911): a, c, g, or t
  modified_base (2942)..(2942): a, c, g, or t
gctcgactttttctnttttttttttttttttttnnttgatattgtgatttttaagttttattgattaaattcaaacttttttatcatttacacaaagaaactgtgacagactctgagaggactaaaaggcatcnnnttaaattttaacatgcatttattaaatttatatgcagatgactacactactgcaattacagaaatgagtaagaacatactctcaagatcttacagtcattggttggggtgaaagtatttcttctgtcttcatgaaaaattaaaaagatagaaaatcttgaagtattttgctaccttaaaacaactacccaccctacatttgtactaaaataggcttttgcttgttttaaaagcaattctagatgaggttatatttttacaatactgtatctcatctcaaataaatttatacattctttaccctgtctaaacttgcatgcaaaataagaaccagcaagccttcaaacttcaatcacagtattccataggctatattttaagtctattgcattagttgaaatttattttgcagagtatgttaacaaacatattctaacacttaaaaaatcattacaattttttctgtttttgtcttctaaattactctgagcagtgaattactggagggaagatacccatgtctaaaatttgtgtctggtgccagtctcagatttctgccaaacaccagtaggtattcaaaagtgtggtccctttaaaacagcaggccggatatcacctttctgtcttcaaagattcaaaccagactcccaatctgggatttctctacagagggttggctgcttcccagttaatgtgagttttgcaaagtttgcatttcatgaaaacagtgttgtgtaaacatatattgtgtcactttacctactatttactaaaatcagagagtttagcctttgaaatttatggttctctggagctatcataaatcaatcagtcatacgaatggactagctgtagactcaggatatcaataaaactaggcagntgaaatttgcctataattatactatatttagattaatagttatcaaaaacatttttccccnaaaaaatacctcaagggtaaaacagaatggtaaagtttttttcaggataatgaattttcaaacatttccaagaccataaccagccattttaagtactgtaaactctgttatatttcatttggataagtatctaataagcaattattacatatcctctcatttaaattaccactgaaaactagaaataatctttatttaatacgactgttttaacaccatatggaacgggaaataactaaatgaaaattgttcacgtaaatgtgatgggaatgggcggnctgcgggagcagtatttcttgacatgtggcatgtcactcaggaaagtaaaaggcccatcatatccanaatgccagcttggatattcccttngccacccacttgacgaacagacataccacatggcattaaatgctgcaacctttcctaaaaatgccacttggattggtccgctgtggtgagtatataagaactcttggtctgtctcttgagtctgtgagttcaaagggaagaatctagtaaataacaccggctaaattttgccctcagatgtttggcataaatgatttgtgaggatattggaacctttggctgttttcacaccaatgaaataaattatgctacttgaaaaaaattctacagaacataatgctacacagtcacagtcgactttttgcaaaagtaccagagaatatcttttagaaacagtgcttataaagccccatatactccttagatatttcccaaggatttcttctcttnnntnnnnnnnaaacaatcttaatattttatttattcttcataaatacaatgtatataatataaaacactttgtgcacatgtttccaacaatttcattttctatgcatctttacataaggtagtagctaataactctttctgtggacacgtattttccagttttctaaggtttatgtgttcaagcattgtaaaaacatatttaaaaattgaattaccagtaaaaatattgaatgtacaggtcattatgctcccacaaatacaaaatacattgaaaaattatatcaacagataattacatatgaaatatgaggcatatattttcttctattatttattttctccctaaagagttctaattgattaaatctcaagagacaaaatgtaattttataaaacaactgtattgttcagatttaggagacaacctaagaagatgattctgagtaggtaggatttttgctattactgtnatgtgaaaaagactgcncaattanaatgnacagattgtnacatatctccctaacaagaggggcgaactgatactacaagcagccagaacaacataattagaatagaattccaaggttatattaatagagtaantnaagttaatntaaaacnaagatcaacntgagcttctatttacaccagttcagacagcccnaagaggaaaagaactctattttangagacatatgtnactctttgagcttctgtcatccaggtgccatttctgatgcagcacatgtgcactgaacagttggcaaagaaggaaaaagattatggtagatgtatgtgcagatagtctctctaatgatgtaaaatacgtccagaaagaaagcagggctttgttgtaaaataaaaaatttcccatgactttttgttctttctgaatgtgatttgagcatgtttctgtaaataagaatatatactaacttatgatgtatatagaacaaaaatagacttactcatcaggaagtgatggnattatacacataaattggcaatgacatttgaaaantttaggatctgntnccatttcntctaaatgtaccatgtatagggtggctgtnaaagcagaaagatatataaaagtatccagtngcacatactatactgcattgctaggtaaggttcttttcctgacatcctatgcaactatcaaaaatcatatgtctgcaaactgaaaatattagcagaaagaattaaagatgttacagtttcagtattgaaagttttggtcccaaaaggtgctttcgtaaagttatttctctttcatgcattgattgttgcttagctaatcttcatcttggtccagatcagggtcaacatccgtggtgagtctttatgcctattgctgttttctttgcttctgcttttaatttggttgctcgtaaaataggtttagtttttttataatcctgtttaccaatttgttttctgtactgatcaacaggaagttttatagtagcagcatcttttctacccatctttgatctccaaaatgcctcagctctgccaaggcaagggccgacaaacttcgtgtcctgtgggaaatgttgctgtccacggttctgtcactcaggggcaggggcgggacaagccagccgca

SEQ ID NO: 374 - DNA, 4654 bp, Homo sapiens
  modified_base (310)..(310): a, c, g, or t
  modified_base (343)..(343): a, c, g, or t
  modified_base (512)..(512): a, c, g, or t
  modified_base (528)..(528): a, c, g, or t
  modified_base (664)..(664): a, c, g, or t
  modified_base (1491)..(1491): a, c, g, or t
  modified_base (1493)..(1493): a, c, g, or t
  modified_base (1612)..(1612): a, c, g, or t
  modified_base (1650)..(1650): a, c, g, or t
  modified_base (1950)..(1950): a, c, g, or t
  modified_base (2035)..(2035): a, c, g, or t
  modified_base (2063)..(2063): a, c, g, or t
  modified_base (2107)..(2107): a, c, g, or t
  modified_base (2114)..(2114): a, c, g, or t
  modified_base (2245)..(2245): a, c, g, or t
  modified_base (2257)..(2257): a, c, g, or t
  modified_base (2263)..(2263): a, c, g, or t
  modified_base (2265)..(2265): a, c, g, or t
  modified_base (2269)..(2269): a, c, g, or t
  modified_base (2274)..(2274): a, c, g, or t
  modified_base (2292)..(2292): a, c, g, or t
  modified_base (2297)..(2297): a, c, g, or t
  modified_base (2299)..(2299): a, c, g, or t
  modified_base (2302)..(2302): a, c, g, or t
  modified_base (2309)..(2309): a, c, g, or t
  modified_base (2855)..(2855): a, c, g, or t
  modified_base (3119)..(3119): a, c, g, or t
  modified_base (3365)..(3365): a, c, g, or t
  modified_base (3480)..(3480): a, c, g, or t
  modified_base (3501)..(3501): a, c, g, or t
  modified_base (3922)..(3922): a, c, g, or t
  modified_base (3958)..(3958): a, c, g, or t
  modified_base (3985)..(3985): a, c, g, or t
  modified_base (4133)..(4141): a, c, g, or t
  modified_base (4624)..(4624): a, c, g, or t
tttgctttatttttttccttttctcttttttttttttttttctctttcctttttttaaatttaaaccattgagacttcagaagagcaggacacaatgctgtggacaggcaccaatttctttaaagaaattcaatgtgggcaaggcatatgtgtaaatttcacttttactttttataaggggttagggagctatttttggttttgtccttcactttccctctgtcttccttctttatacttttctcagttctacttatgacacctcacttccctagagaaggcctgcctccccatagggaatctgggggtntcttctggaacggggcgtgaggacacaaggagncctctgggccacgcctccctaccagatgcaggaactcctggactccttggtgggctggccctggctagcccttgggcctcggagatgatcagaggtgaagaaccgcctggaagaggaaggccagggtttggccaggagaactaagaaggtctcaactccaggctttgtngtgtttaagctattgngagccccaggccacaccaggacttgcagtggtgggaatccattcctcttctgccctgtgttgcagggaactaggaggtaagggtggagggcgaccatctcgctcttgctggcggtggagcagccatccctgccttnctgttgggaaaaactgttgtgccaaactcttgtgtggaacacagctgggtcttcagcaggcatctgtcactgccgtgaggtcagcgcttctcacctaactgcctcctggattgtcatcttcccagatgtgtcccatagtgtccaggtgtcacagagacggcctgaggccctaagatctggttgtgactttgccatgataacagggtgtcctgaactggctgccgttgtcgtgttctcacagtgaagggcgtgccctgtgtgccggggtccatggtgtcatatgcagtgacacacactgtcaagcgccatttccctcacccctggagacttactgttaggtgcctgccctcagtatagacgtatccaatgggaaaacagcggacctgcccagagcagggaggtgtcgtggaactgggtagaccccctgcagcgttaggggcccatttgtgggctcgccaccttcaggcttccccagccatgacacttcagccccgccacccatgcctgtctgctgcagccatccttgcactctccagcgacactctcgcacctccctaggggaagcttccctccccctgggctgctgctctgagcccgtctgttctccccctgcaagaaggggcaatgctcttgtgttgtccctctgtctggacgcgcctggccactccgaaggcttttcaccccattatggccaaatagtatagggccactggggagggggaagggaatcattttgtgttcatttttgttttctgtttcacctaaaccagcataggattgataggggagacggttggcgggcatttccgtttctatgtgactatgtnancaaggcagcaggggcttttacctgctaggcggcagtcctttggccctgagaatttgggagagaacagtgcatcaggccaggctcagcaatatgtttgctcacattctttcagccttctntcacccccctcaacaccaaactttcttccttgtgagcngaaggttggctgctgttagcaggatcccacagtgataaccaggcccttcccttcctaagccaaaacccattgtgactgcctgtctctcctgtctctgacttctcaggcagcctcctgagtgcactgagttgtatccgagagggtgggaacagcagcatcccctaattgcagtacacggttccttttccgcccgccaccctgcctttccttgggggcagctgtctctctgtacatgagcaaatgggcaaaaacagtccccaaacccagcacccccctctccctggctgcagcccacactgnaacatccctagtgaggctccagcctaatgagccccttattttctttttcttccctccccaggtctcgtagctctaactaaaaagntcttggagccatcgtgctccccctttgntatttttcttgctatcagagtagcaagaaacagcacccctgtangtgacangtgggcagcctggtaggggtcgccagcctccatgccccctcatcttccagttcttgcttagtggcacgacctctttccatagcataaatgcaggccagcgttttagccccaagtgcctgcccttgcttctnacccctcccctnctttcncnaaanacttncccacctcaggcactcancgggncnccnccgtggntgagagaactggccgtggctcagccccgggtagcacctgtagtttcagtgccactctccactgtccccttgtggaccagcttccactcactgtcacgtcccccctcctgcgtcttcactgggtctcaggctgccagcagctctctggtgcatcgtctcaacaccaccaagtttgtaggacctgcccaagttctagtagtattcaaaacttcaaacggcagtcatttgttctcctcggctctgtggcaaggatagccctttggagggggactcttgacctcggctgttagggatctgaacttggttttcccgtcagaagaatcagcaggacagatcgtagtgccttattccattgtcctcccctggccaggcctcctggctcagctggaagtgcatggcttctttctccctatctgtgtcctctgtcacttgctctttcactctctctctcattcccagagagccacgggggagggatcaccctcacccccaacaccctcttcctgagggctgtagccaggtccgcatctccccaccaccaccaggncactcactcgcagctatagcccaggacagaaaaactgtgctttggacaggtgcacactctctgcctcttacctctagccaggaggatgcctcagtctgttcattcgagactggccccgtctgaaccttctctgggcactggggactaaggttgcaggccttagcctcgtctcgtcccagaggcattgggtcaggagaatgggaatttttttcctcccacctggacatagtttgcccctgtggctgcctttctgagggagtatantaaatgtttacttaagaaacaccctgtttacagccagaggagaaacacccaacactgagtggagatttgactctggacagggcctggcctccttagtggcactgccggggggccccagagcgaatgagggcagagatgcccggggcaggggcaaacgccctccgctccctctgctcccaaccctgtggtgctaggaccactccccgccttccctacggcctcctcgccctgcacattccccacctncacattcccctcctccaagatctcagctccttaacatatcagttgtctcctagcctagaaaaccagtgtttggagcaataagatgattatttttgcttgaatctttttctaaganaaggaaaagagctggcattgngggaattttctttttatgctgttagctgtttaccttcttagaagacatcctaataggatggatgtctgggttttagccttggggtatcttttggaaacttagaaaagcaggagtcaggctgccaccccctaaggagggaccctaacgttctgcccttgcctggttccatatggctccttccagccctgcccaccaagtgcagctcccactttccatcctgcccatacgcccctcttcccccgacatctgggggcgctggtggcacttactctaggttggtctcagactatccctccccttggctggttttccctcctaggcctgtctggcagcccccagacagacgtagctcctgggagtctcggccctggcaaccttggaagagccaagctgacattgtttagctcttcaggccactggnttttggaggcagaagtccagagatactggctctgcnaagctgtcgtactgggctgtggcacanccttcgagacaacacgggtgtatctctgatcctgccctacctaggcttcaaggggcttctgtctggagaaatgccctcaaagggtaaccagtaggtgtggcattgaattggccagtgttagcatctacagccatcaccgagatgagtnnnnnnnnnttgcctgcccgagggccccctaaggttatagacggtatcagcagggaggccgtcccgctggttttctaggagagcccacaggaggaagggagcctcttcaggggcactggaatcttttgtgccaggggcttcttttcatcagagccggggagtacattgcagtgacttcttaaacatttgtgtgggacagacgagcgtgagggaggttttaagccaggcacaaagttagtttccaatactagttaataaatctatttttcttcatttcctttttttgcacagaagctggtaatctaggacctacgtgtgaacaactttatatgaatattttttgtacttggtttacttgggttggtatgatacattatatttaagttccttgaacactgtggatcccctaatgtgtatgaatgactgaggctttgtaaattaagggacgtttgtgtgaataaagttatttgatggggtcaaagaagccatatntgatttgaaaaaaaaaaaaaaaaaaaaaaa

SEQ ID NO: 375 - DNA, 1692 bp, Homo sapiens
  modified_base (4)..(7): a, c, g, or t
  modified_base (29)..(32): a, c, g, or t
  modified_base (687)..(687): a, c, g, or t
  modified_base (1138)..(1138): a, c, g, or t
  modified_base (1158)..(1158): a, c, g, or t
  modified_base (1172)..(1172): a, c, g, or t
  modified_base (1573)..(1573): a, c, g, or t
  modified_base (1681)..(1681): a, c, g, or t
ggtnnnntttttttttttttttttttttnnnntttcagctaaaacgtttatttctcactcaaaacttatttcccctcaaccctatacccaaagaagaaataaaatcacagatacataacagaagtatttgaggtaccctctcatatatgcaaacaaatgcagactaggcctcaggcagagactaaaggacatctcttggggtgtcctgaagtgatttggacccctgagggcagacacctaagtaggaatcccagtgggaagcaaagccataaggaagcccaggattccttgtgatcaggaagtgggccaggaaggtctgttccagctcacatctcatctgcatgcagcacggaccggatgcgcccactgggtcttggcttccctcccatcttctcaagcagtgtccttgttgagccatttgcatccttggctccaggtggctccctcagtctggactctaccacttgggtctccagattttctgttacgtccttgtgggtcaggatatttctggaagtcactccgtgaggctggtaatcctcagacccagcttctggtcgactctggaatggactgaagctgggcaggatgatgagagccagggaaaaaagaagaatcaaaacacaagtgctggtctgggcagctttgttggaagtttgagcaattagcgtctgcagctggcggagntgagctaccaaggagatgttgtgcctctccagctcctggacttttttctgtaattcttggttctgtgcagaacaggctgccaccctgctctccagcccatcaatgtactccttcttccgccgccgactgtcctgagctgactgcttgttacggattttcctcctgaccttcttgaggaccctctcctctgccttggtgaggggcaggtgagagggcagggaaaccccttcctgccccagcagacgcttctcctcatcggtcaggaacagggtttgacagggcagcagggttgtacagggcactggggctacggtgcctgctctgggcaggatgtgggcatgagcatcaaagggcagctcactgaccatgcaggaatcaggcaccataaatgctgggctccactgatctagctggatggagataaggcctacatttggcccagtttcccccntgcatcctctccagggcccntgcctcatagacancctcatagagcataggagaactggttgccctgggggcagggggactgtctggatggcaggagtcctcagagatgccactgtcactgccaggagatgcttctgagcagtacacctcattgggatcaatgaaaagcttcaagaaatcttcaggctcactctcttgaaggcccggaacctctggaggggggcagtggagtcccagctccaggacggatcctgtcgagaagatatcctctgggggctccagccacgcgtccagcaggtcagggattccgagatccatgcttcttgccaggagccacggtagggccgctgtatctgggagtaggggactaagagtctgagggtccacaaacggaatttaagaagtaggtagccgcgccctttctgctgcagttttntcttagctatagtaaatcttcctgagggtttggtgtctcctagctgaagaacagaaaaggctgtgactggagcacaggactcctgaatgcctgttctgtagccctcgnttttgcaagag

SEQ ID NO: 376 - DNA, 2061 bp, Homo sapiens
  modified_base (696)..(696): a, c, g, or t
  modified_base (798)..(798): a, c, g, or t
  modified_base (801)..(801): a, c, g, or t
  modified_base (821)..(821): a, c, g, or t
  modified_base (882)..(882): a, c, g, or t
  modified_base (1080)..(1080): a, c, g, or t
  modified_base (1368)..(1368): a, c, g, or t
  modified_base (1372)..(1372): a, c, g, or t
  modified_base (1376)..(1376): a, c, g, or t
  modified_base (1380)..(1380): a, c, g, or t
  modified_base (1412)..(1413): a, c, g, or t
  modified_base (1426)..(1427): a, c, g, or t
  modified_base (1460)..(1460): a, c, g, or t
  modified_base (1465)..(1465): a, c, g, or t
  modified_base (1467)..(1467): a, c, g, or t
  modified_base (1481)..(1481): a, c, g, or t
  modified_base (1491)..(1491): a, c, g, or t
  modified_base (1495)..(1495): a, c, g, or t
  modified_base (1509)..(1509): a, c, g, or t
  modified_base (1519)..(1519): a, c, g, or t
  modified_base (1558)..(1558): a, c, g, or t
  modified_base (1568)..(1568): a, c, g, or t
  modified_base (1612)..(1614): a, c, g, or t
  modified_base (1620)..(1621): a, c, g, or t
  modified_base (1625)..(1627): a, c, g, or t
  modified_base (1637)..(1637): a, c, g, or t
  modified_base (1648)..(1649): a, c, g, or t
  modified_base (1656)..(1656): a, c, g, or t
  modified_base (1831)..(1831): a, c, g, or t
  modified_base (1918)..(1918): a, c, g, or t
ttttttttttttttttttttcaaatggaagaggcttttatttgtaaagaaatgaacttacaactgatctacaatatattattgtaatataaacaatataaataaatgatcctgtaggcccactaatcttccatccagacccacatgaagcaatgttacaacaatattctatatgaaaatgtgcaggtaacaaaggtgcaattacaagcaagttaagcagcagagtataaggtgctttaatttaatagttaatgttgccatcaacaaacatttaaatgctcaatttacttcactgaatacagacacaacaaatatgaaaatctaaattcatacacatgctacttaatatgaaagtgctttctcttttttaaaaaaatacaccaaatggacactttttacatagatcaaatgtgctcttacaatgcaaaattaaccttcattttcaggttatacattttaaaactgtagctatcaacaccaatctaggaactctaatgctaagagtgctaaaaactatttcatttcttgtaaggaggactctaatacaatatccaatgtaaagaatacatctatatataatcttaacatgttttctgtaaagataaaaaatgttttctttccccttggtgatctttgttcatcctgggtggatcatcttttgaggttttaataatatgaaagtcctattttagaacantgggaggaaccaaaaggggaattaaaaaattggttaacgtgtgcttgaagcatccaaaaaacaccagtttatcacaacaattggtctttgctaaaattaacnaanttttaataagcaagacgacnaaaagtactaatttaaaaggcttgaaatgcctgccaccattgtcagtatccatccatccanccttcatttactacaagcacaatactactttgaggatagtttttggaacttattttgacttttttccctataggaaaaacaaagaccaagcttttgaaggagaggactgggaatctagtttaaatgtctacatccaaaattatatcatctttgcgcattcagttgactttttaaaatttaagaatacatatacaaaangtacttatggaatacatattttaacagcataacatatttgaagaattagttacactttaaaaattaaaacacttgaaaagtattttttaaaccagtaccatggaataactttttgaaacccagattatctggctacttagatgatagtcttcctgttttcaattagtttgaaagattctaatatagattctaacccaacagtttatatggatattttcctgctttaaaaagctgcaacaggctaggcgcagtggctcatgcctataatcccggcactttgggaggctnaggngggnggancacttgaggtcaggagttcgagtccagcctgnncaacatggtgaanncccatctctactaaaaatacaaaaaactggccnaggcntnagtggtgcatgccnagtaatcccnagcntacttgggaggccnaaggtggganaatctattgaacctgggaggtggaggttgcattgagccnaagatcacancgctgcactcaagcctgggtgacagtgagactctgtctcaaaannnacaaannaaannngctaaaacantgataaactanntttaatnagatattttcattctatatctttatggagaatgtcagtatcaactgatgttaacaagtaaagctttgtcaacaggaattacaatgtgattcacagatcccagaatgacaaggaagggaccttaacccaataaatgattctcccattcaatgtttaccccctagatacttaacaantcaagcatggaactgtttcatgtttacccgttctacatttaaaggatgcccttttactatatatgtgctttctagaatattactgantcttacatatctttaaaagttggatatttgtaatagcttaaagtacagtaacacttattttgtgtaatctttcttaatttaaaaacaaaaaataaatgaacaagtcagttccaatgatctcctttgagatttttcagttttag

SEQ ID NO: 377 - DNA, 756 bp, Homo sapiens
  modified_base (33)..(34): a, c, g, or t
  modified_base (37)..(40): a, c, g, or t
  modified_base (42)..(43): a, c, g, or t
  modified_base (166)..(166): a, c, g, or t
  modified_base (681)..(683): a, c, g, or t
  modified_base (685)..(686): a, c, g, or t
  modified_base (688)..(690): a, c, g, or t
  modified_base (692)..(695): a, c, g, or t
  modified_base (697)..(697): a, c, g, or t
  modified_base (699)..(705): a, c, g, or t
  modified_base (709)..(709): a, c, g, or t
  modified_base (711)..(711): a, c, g, or t
  modified_base (713)..(715): a, c, g, or t
tttttttttttttttgaaggaaataagaggagnnttnnnntnntacgttcattcgttatttatttgtgtgcgaccccggctccccgcagcctccacccctcccgcgtcccgctttcagaaggaacgcggccctcagctccctccgaagaggccccgggtcaggggntgcagccgggtccccgtgcgtcggcccagctcgtccagcaccgccttctccttctggaacatctgctgccactctgcctccgtgccgtgtgtgaatcccagcaagtgacagagtccgtgggtggccgtcacagtcaggacgtcattgtaatcttcattttctttacactgatggaagatatactccactcctaggaaaatgtctcccaaattgtagtcatctggaaaatcaggctggggaaattcacctgctttcagatgctcatgaaatggaaaagaaagcacatcggttgggacatttctatctctgtagattctattaatgtgctgaatattcttgttgtcaacacagatgatccccaggtcaaatttctgcactcctaaaatcctccttacaatctcgatcttactgcgaagtggcgctctcctgatggggatgactcgctgcagatttctaatcaccaaactcatttcaggaagaataaccagccctttaaaaatgtttgcaacggaacnnntnncnnnannnngnannnnnnncgangntnnntggaaggatgccgctggaatccggccagaagactccagcgg

SEQ ID NO: 378 - DNA, 2663 bp, Homo sapiens
  modified_base (155)..(155): a, c, g, or t
  modified_base (175)..(175): a, c, g, or t
  modified_base (186)..(186): a, c, g, or t
  modified_base (193)..(193): a, c, g, or t
  modified_base (224)..(224): a, c, g, or t
  modified_base (292)..(292): a, c, g, or t
  modified_base (309)..(309): a, c, g, or t
  modified_base (383)..(383): a, c, g, or t
  modified_base (858)..(858): a, c, g, or t
  modified_base (1484)..(1484): a, c, g, or t
  modified_base (1486)..(1486): a, c, g, or t
  modified_base (1488)..(1489): a, c, g, or t
  modified_base (1492)..(1492): a, c, g, or t
  modified_base (1496)..(1496): a, c, g, or t
  modified_base (1563)..(1563): a, c, g, or t
  modified_base (2261)..(2261): a, c, g, or t
  modified_base (2263)..(2266): a, c, g, or t
  modified_base (2268)..(2270): a, c, g, or t
  modified_base (2273)..(2273): a, c, g, or t
  modified_base (2275)..(2275): a, c, g, or t
  modified_base (2277)..(2278): a, c, g, or t
aaatatctgaaatacagaatacgaatttaataaaggaagcctaccttatgtaaattatgatgttgaaaatgacagtcaaccagagtagatgaagtgtccttatgaagaattattaaatagtagctggatggatctttagatggatgaccacctgnaccattccaggacaattttnggtcccatttngaggatngccatagttgcaagtccttaggatcttcctngttttaaaaaactatcaaagtaggttaaattaaaatctaatttaaattaggttaatttatattacatngtagatcattctttttncccccctctttcacttctaaatattttgctttctaaatactagccttctggttcacagtgaaataatttaattntcaatcagtagattgattccaagtggagaattcactgcttccctaaaatgcgtttttcttacctgtaatggtgaatatttacaaggatctggataaagagattttgatttttgaaatgccacaaaaccccttaaagtggtcaagtacctaaggtagtggctaaggcatgcttgaactgtgtttgagagacagcagttcagtcagtacataatttgttggtgactaacaaagctcacatctgggagattaactttttttaacgcaaaaatattctgcacattacccatatattgttgaattttacatacaaagcattttgtgctttcattcaattagtttaactatattcagtttctgtattatttctctctgatctatcctgtaattattctatactttagaagaaaagatcagttcatattgttagactgaataattctacatgaagttaaaagttagcaatttaaaaaatttngctgcataataaagataattatagttacatgtattgatttaagtctcacacactgtgctaataagtcctttgcacatattattggattctagagcaaccctaggatttgggtactattatttccatttgacagatgaaaaacctaatgcatagaaagataagtagaccagtcaaggtctacagctagtaaaatgctcagattgaaacctaaatcttttctcactcacttttaggttctatatgctattctccttacgtaacgttaaatagatcctttagtttgataggttcattagttttgcttaatcgttgcttccaatatgattcttattgtagtatttatattacaaagttggcatacagggtcaatatctaatttactgttgtgtttttcttaatatgttcaatgtatggtcatactttttaaatttgattttttaaatattataagtggtcatgaaattttaatgttaagtttgtacctaatagaaatatgtctatcacaaatctttattggtattattttatatacttttccagcttgataattttcacaatagaaagagaccaaatattttgtactatattttgtgacatagaagtaaatgacaactctaccttggaananannaanaaancagtgtttttatgttcaaaaactattttaaatgtcataggcttgccaattgtgttaactatttagtncattggtagtttttaaatgactaatgctggagtgaaaatgtaaggcaaaatatttagtatattaacagtagatagtcattttcatgtaatcagaattgcatgttaagggttttaaaagctgtcataactcttaccttttatttctaccagtgatcaatcatttctctttacaaatttagggaggaaacaactgttcaaatgtataggggacagaaacctgacatttagagaacagaaattttaattgccaaattaaagcagctaggctgcccctgggcttaacaaaattcctatttttgaactagacccgaggtattttatcattattatttgataggtaccattaacctttgttttgtgattatcgacttttggggggaaagatgagtaattaaacacactcgcccattttctaagtggtttagaaggttgcagtctgcctcaccatacaaagccagtttaaataggaatatatcacatcatacttcacatagcagtcaacctcagaggaaagtcatttattcagaaggcatagattttgctagacagcagtgatgcattacaaatatataattatttgcactaatatttgagcaggtggaatggattagaacatggtcaacatcatgctgctgataacatgtatttttctatattaatatgtactgtgcaacatgtattaaaattgtcaataattnannnnannnaananannaatatttatattactgtgtttaagagacagtatccaactgagccacttttaatttaaaagtctgaaactggaattaagtttactttcaaaaatcacttaaattactttataatcagtgaaaggtcagtaaaatgtagaattataagtgcctagtgacttaataggaggaaatatggagggttaaggaaggaagtaggaacctggaataagaaagctaagtttcatttatagttccaatgagtgactttctttgttttcaccactgggaatcttaaatgaagaaagtgtcgtatcccttccagttatctttatgttaataaactaagtgaagtttggatagaactaacaaaggaattagtctccattggtggacttccagagtttt

SEQ ID NO: 379 - DNA, 662 bp, Homo sapiens
  modified_base (144)..(147): a, c, g, or t
  modified_base (157)..(157): a, c, g, or t
  modified_base (161)..(166): a, c, g, or t
  modified_base (379)..(379): a, c, g, or t
  modified_base (591)..(591): a, c, g, or t
tacgccaactggcgaaaggggaatgtgttccaagccattaagttgggtaacgcagggttttcccagtcacgacgttgtaaaacgacggccagtgaattgtaatacgactcactataggccgaattgggtaccgggccccccctnnnntttttttttngaannnnnngagattttgcgttatattttttaaatgaagcaatacaatcattttttatgtatatatctagttgaggagaaaaaattacagattttttcccccttactccaagataatctaaacagattttactctggatggcttaattataacataatccatgaagttatagccagggggttaaataagaagttgatgacaaacttggtttctctaacaagnatgcaagaaaactcaagtgccacaatgaacacccataaactgctgtcaggaggcaaagtccctatgaggtaataataaacccacgaggttaaggcaaaaccctacggttgtttctgcaaacaaatgtccaggaaactcaagtttgtgatgaaagaacagtcttgaattcaacttcagcagaacctttccctccctgggctccaaagcactangtcacctacctctccactcaaatgccccattaagtaccatcctgttggagcttcctaacgcccctgctccc

SEQ ID NO: 380 - DNA, 644 bp, Homo sapiens
  modified_base (23)..(24): a, c, g, or t
ttttttttttttttttttttttnnttcaaaaagcatttttgtttaatgctaagatcacttcagtttccaaggtcatataaagaaacatccaatttagagaaaaaattctgtaataagttcaaataccaaagcgtaaagatgatgtaacacagtgcctatgctgcatggttacacaaatgaaacgagaaaggtagtgattgcttctaaattctcactgaaaatccaatttaaaggtttattgcagtctaggtatttttaatttttcccttggtgattatcaagatggttgatgctaataagtactattaaaaaactaaaatgctgtcgaatatggaacttcttttagttaagaattattaatatagaaaatgtgagttggtggactggtacttcttgtgctctgatttttatttatttattttcttcttttttttgagacagtttcgctcttgttgctcaggctggagcacacaggcacgatctccactcactgcaacctccgcctcccgggttcaaacgattctgctgcctcagcctcctgagtagctgaggcaggagaatcgcttgaacctgggaggtggatgttgcagtgagcagagatcgcgccattgcgatacagcctgggcacaagagcaaacttcgtc

SEQ ID NO: 381 - DNA, 555 bp, Homo sapiens
  modified_base (70)..(72): a, c, g, or t
  modified_base (499)..(499): a, c, g, or t
  modified_base (501)..(501): a, c, g, or t
  modified_base (503)..(503): a, c, g, or t
  modified_base (507)..(508): a, c, g, or t
ttatagggcgaattgggtaccgggccccccctcgagttttttttttttttttttactgtagaaagaaaannntatttgcaaaagttttattttaaaggatcaaaaataaatactgcacatatacacagagaaaatccactgatatttatgttctttgacgcacactttcaatacatggcaccttcatcttctttattgagaaaataaactgttatgggtccataactggtatgcacagtctctgtgactctggcaaataaccaggagccaagtccatataataaagttggaataccgaggttgacgaccttgagcgccgtgaagaagcggttctgccgggccaggtcctgccagggagccttggagcagtggtacttgatgaaggggaagcagccggtgcgcaggacgtggtagttggcgccctgcaccggccagttgaagtgcgagaggccgaactggtcgttgcggacggcgctgtagggcacgcagaaggaggtcncnangcgnnaggcgccgctgcagcagatgccgcgtcagcacctccgaggcgctggg

SEQ ID NO: 382 - DNA, 949 bp, Homo sapiens
  modified_base (57)..(57): a, c, g, or t
  modified_base (679)..(679): a, c, g, or t
  modified_base (691)..(691): a, c, g, or t
  modified_base (718)..(718): a, c, g, or t
  modified_base (759)..(761): a, c, g, or t
  modified_base (808)..(808): a, c, g, or t
ggccgcgctgagcaggtcatctttgtccgagagacccccaacacagcaggcgcaggngccacaggcggcatcatcgggggcatcatcgccgccatcattgctactgctgtggctgccacgggcatccttatctgccggcagcagcggaaggagcagacgctgcagggggcagaggaggacgaagacctggagggacctccctcctacaagccaccgaccccaaaagcgaagctggaggcacaggagatgccctcccagctcttcactctgggggcctcggagcacagcccactcaagaccccctactttgatgctggcgcctcatgcactgagcaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtgagctgccatgcgcctggcgtctcacatctcacctgttgatcccttagctttcttgccaaggatctagtgccccntgacctctggcnaggccactgtcagttaacacatatgcnttccatttgtgatgtctaccttggtggctccactatgaccnnnaacccatgagcccagagaaattcaccgtgataatggaatcctggcanccttatctcatgaggcaggaggtggggaaggtgcttctgcacaactctgatcccaaggactcctctcccagactgtgaccttaagaccatacctctcagccccaatggctcgagtcccccaaaattcacaaaggaagaccc

SEQ ID NO: 383 - DNA, 4599 bp, Homo sapiens
tttcaattaactgttccatttttttaaattgccaatttatttttctacccaatccagtatcaacgatatacaaaaggatataaacagactatcatgaatatttacaggatgacacaccaaacaattaccaaggaacaaatcctgcaaagtaacaaattgttgcttatccatgtccactcaactgtacaaggtttatttctaggacaatttcccagttctctgggaaggaagttctgtggatttataccttccataagggtcaagcaaacatgctaagagctgataccatcatgtttttatactaacagccgagaaaggcttttaaagaacactctctttcaggccaatgttacagcattagtgggctcatagacaggatgtgacttcatcaaaggaaatgcttctctcctcttggtctccctaaggtcctcctcctagtacacaggaggagttccccataataacaccctggttccaacagatggtgtgtagattatcaacacacaatgagaaaaagaaactgacccccttacctaccaaatacaatacagatctggggaggcagtttccagatcttcaacaggcagacactatgtggcctgtatttagtacacagcacattctcttaagagaaaacaggaatgaacattctcagaaacattcacattgctcatcaaatgtagctttacccaaagtatataggaaatggcaaaaacctaacctagctggacattttatacaagtaagtcaaagttcaaaggaatcatcctatctttattctcagaaatccaatgttgaatatcacagttcttctttaatggaagcagaagattcagagtccttgtctcccaaaatgcctcagccagggtcagcacagagagtggaatataaaaagcttaattgtgttaatacatggaagacaacagttctcagtcaacctagccacaattttctgtcttggccatctgtaagaaatgactacgtttgaaattcaactttcacattcaaaaaaaagaaatcaattcagcttcagacacaaagcaaaaccaaaacaaaaaaacaaatggcaatagtctacatatctaaacacttgacaattggggaactgtcccacagtgatatgctcaaggccagtagcacctatttataatttggcatgtactgcttgaaggggcaacaggacccggagctaaaatattcaattataaagatataatacatcgatgaatcagacaaaagtagacatatatgataccacattaaagattcatatacagtactgtgctgactttaaagaaaatattttgggacactagaaggaaaagacaataggaaaagaattacaaaggagcatttcagtccaaagccagtccagtgaatatctatgactaggatttccaatctttgatctccaaagaagctgatctaataaattctaacaatacttcgttcacatttgggacacacaacatacttccaagtacagtaatccctctgacgttttggtttcacttgctatttgatgactaagttgtttctggctataaagatcttcctattttaattagccatttaacactacagaggctgctccctttgagagaccagacaagtttcacagaatttgatctaatgaagatgaatggtggggaaaaaagggaacatttcctgggtttttttgcaaacctttttctcttgcttgaaaaactctgcaatcacttaatgttttgctccagaaaaagaaagcaaaactagctgggaaaatacccatacattaatacttcgtgtttactagcatgatacaaaataaattcatagatgtcagtcaattgtttcttaaagaccaaatgtgaatttttaatcttgtaacttaagaactgagtttttccacattcctttatatagagttagcatctgtaaactgagacccttttttgggtaatcatacaaatttaatttgtccctggaaacaaaaacccaacctaacagattaacaaaatatgtccgttagacaatattttttgtgaatattgctgcactgttaccatttttatccttcagtaaatgaaactacacttaaaaagtttatgtattttgagtttacaaagagctaaactcttaattaagaagactatgaaatcaacctatactcatttcagaactggcttccctcctttcaaaagtaaattctaaaagttttttagttattactattaagttatatgagctagagacatttcgactgccatcaatgcttctgtaaaattgaataaagattttattataccacacacacaaaaagcaatcggtacagaaaaggcagttttcagttattctgttgagaatttctttccatgatttctcccattaaagtatagttttcaaagcaaccaccacgacaaaggaagcatctaattagtccgttttcttctgatccaagaatgctgaacatttactgtcccatctgtagttgtatcagcagtgtaatgaacacagtttatattacttaactattctttgaactccaagaactgttgaagtcttttctgatgttctgcagatgcttgcacagcattcagatgttcaccaaatgtagtagttattcgatagatggcagttttcagtgatgctctgaatgcaaatcttaatgttttatatgaagtgtccacaaggcttcctgaaatccggggtggtttactggaagcatgaggaagcttaaagtacttgtcgactgcctcttgcagtgtcaacaaagtattaaggatagctggtagtgtcgtctggacaactccaaatctatcctctgtaaatgatgctgctactaagtgcgacagaccttctaatgcccaaatatgcatttgggcatctgaaaaaacagcctgaatggaggcctctgggtgcctcagcactaatagaggtagatggagaaggattagaaaattcagtcatttgctgatcagaagctgatgtccacaatcttggcccccttcttattagctgaggactttgcggtgacccatagcaggtgtttacatcaaaaattccagccatccgattcattacactagagccaaatggggtcccaaatgggctcacaacatcaggtgtagataattttgaagaaaacagtgatgttttaactaatggtggcactgaaggccgaggcatctggctagattttggtgtctgaaaagcagtttcttctggagaatttaatttcttaggttccactgggtaagatgaagacactctcccattcgtagcagcagcttcttgatagagaatcagtttctgagtcataccatttaaaagattcaaacactcccttgaaatggctgtccaattgtggggatgtccacctggttggctgaggctgaaaacttcttgtcttcgtgaaggagaatattgagaaagcaacatcaggtcctgcaaggctaaatactttatgatggggggaggattgctatttaacacttttggaaggcactcatctgacccttctgcaaatggtggttgaacaggaaacacatgagcctctgtggcatagattttgaagagtatccatgagacataccaagtcgtcaggagaaagacaccacacagccagacatggtagagtaacgagagatttaagaggccactcactgtgtcaagtggcctatgaacctgctcatctatgtgaaggttcatagcagtgctaatccaagctttgggaatatagccaagaaaataatataaaatgcagaaatttctaaccaggaacagtgattccacacaactgtgtttaactaataagagcagagatctcctaaaacgcaagaacttgtattgctgtatgatgggaaatggaagatagttcatgttgttaacaaaatacaggaggctatagctatagcccataaatgctccagtcagtaggaaaaaaagatgatattcatttaagcaggtttgcgcagcagggctaccaaagctgttagtaccagtgcagggaaccacaagaaagctgtactggccctgggttatcactgcagcacaccaggccatcaccattcccattgcagcatgaataaatgagtgcatgagttgctgaggatgaatgatcttccctatcagagctagtctggagcaaggaatagaaggcacaactgcatagaactccacattgaaaatacttattattattattaccactgacagcagcaggaagtaaaagattacataggaactatacaggtcactgaaagaatcagacagccactgtataggatgaaacaaatcaatcctgctgaaaattataaatactgtggtgcagatgggtagaaatagcactgaccaaacaatacttgcaactatcctccagcccaaaacgcgccacagtatgtcccgcgacctgccggcgcagggccggctcacggccgtggccatggagatggcggcccctagtctagggcgtacaggagaccgtgcgcccgcccgccaccgcagttcaaaggcaggaaggccccaggaggaccctgctgggtctgcctcaaacgctgcctgagcgaagcccggcccaggctccaacccatccctgcgaggcttcgtctggacaagctc

SEQ ID NO: 384 - DNA, 1395 bp, Homo sapiens
  modified_base (152)..(152): a, c, g, or t
  modified_base (332)..(332): a, c, g, or t
  modified_base (368)..(369): a, c, g, or t
  modified_base (415)..(415): a, c, g, or t
  modified_base (431)..(431): a, c, g, or t
  modified_base (465)..(465): a, c, g, or t
  modified_base (467)..(467): a, c, g, or t
  modified_base (473)..(473): a, c, g, or t
  modified_base (475)..(475): a, c, g, or t
  modified_base (553)..(553): a, c, g, or t
  modified_base (606)..(606): a, c, g, or t
  modified_base (847)..(847): a, c, g, or t
  modified_base (873)..(873): a, c, g, or t
  modified_base (929)..(929): a, c, g, or t
  modified_base (1228)..(1228): a, c, g, or t
  modified_base (1342)..(1342): a, c, g, or t
  modified_base (1385)..(1386): a, c, g, or t
  modified_base (1388)..(1394): a, c, g, or t
aaagcctttaacaagttctcaacccttattacacatcagataatttatactggagagaaaccctgcaaacatgaatgtggcagagcctttaacaaatcctcaaattatactaaagagaaactacaaacctgaaagatgtgacaatgattttnactacacctcaaacttttctaaacataaaccatattggtgccctagaaatgtgaggaatatgacaaggactttaaatggttgtcacgcttgattgtaggtaagataatttatattggagaaaaatcctccaagtatgaagaatgtggcaaacttttaaccaatcctcacaccttattgcncaggaaagcatttatacttgagaaaaattgtataannaatatggaaaagccatttatatctgctcacatgtaaaaacatcagntcatacttaataaaangcaattaccgtcaaatctttcagaaaatataagncnttaatncngaggaagagtattcttaagatgaacattacaaatagaaagagggttgtagtacctttagttttatgatagatcttatngtacacattttgtaccagaggaaaaccctaaagcattagttgctcaaactttngttcgacatcagggaatttgtattggagaaaaaccctgcaaatgtaataaatatggaaaaacattttttcaaaaactacagcttggaaaacatcagagagttcatactaaaatatatttttgcagatgcagtaaatatgaaaaatatttaatcccaaattaagtctatgtaaatatcagaattcacagtagaaatcataaggcataaggcactgatacttcagacattacactaaattagnagtgttgagtataggagatccaaaantaaaattgttaggtaagttatttatatataactttaaaagaagtagaagatttttnggagatttataattacattcaaagtatacttttttcttgaaaaaaattacagattttttgaaaagcaattgatgtaatttaactctcaaattcatgtttttcttcattcctattatattcacatgtgaaagcaagtgatctgttgttgctgaatcagagatatgagagattcttttttataggtgggcattatttatgcccctttctgtggaagagtaagaaaattaaaatacaagatgcatgaggaaaatgtagagatgctctttgtgattaacttagaatattaagtgctacttgangtacatgttcagactaacattcttttgcagtatagtgagaaaaaaacattttaaaattaattatcattttgttgattgtgcttttatgtaataaaatgcagtactttaaaacanttagattgtgtgtgaacttaattttgtaattaaacattttttnnannnnnnna

SEQ ID NO: 385 - DNA, 1067 bp, Homo sapiens
  modified_base (45)..(45): a, c, g, or t
  modified_base (683)..(683): a, c, g, or t
  modified_base (685)..(685): a, c, g, or t
cccccaaaatttttttttttttttttttttttttttttttttttnaaagaaacaggatttgttttaatgcatgatttaaaaaaatctacattgtcagaatgtaaatctgattatatcacagtacagtggcctgtattgttttgcacatacatttttaacatttcttacattttgaagaaatgaaatacatgaaaataataaaaaaagcacacagtatagaaggataaaataataccaatttctttctcttcccccaacccaaccttagtctctctccttaaaagtaaccactattaacagtttatatttcatactagaaagaagtctgtatatatactggtaaagtacatatacattgattttggtagaaacagtgaggaagagcctcagttttctttctttccaaacagctgctgattatctcaacatcatttattgggaaatgccagtattatccctattgatctgaaatccaacctttattgtatactaaattctcagatgtagttcggtctcttgagactgttctcttccattgaattggtgcttccttctctagtactctaagttatagacaattcactctatactgagttattgtttcacctagtcttcctcttcttactcattctcagactgtttatgtctcccatgtttgtgttggtcaagttccccagactaancntgttggcattttagttgggatttctaaatgaaatacttacttataatttggaaaaattacagaatttagtttttctcaagaacaaaatatatctttccagttattttagtggtttttaaaaaatatctctcaggagagttttaaagttttcttcccatatgtgtatcacatttcacttatttttagatatttgatcatttttgatgactgttgtaaacagaaatattttcttatattttaagtggttatttgtctaggaaagcttttatttattaacacaataacgagtcacctgactaaatcatcttgctctaaattgtttccagttgatttgtttttttctagatatgcaattacattagctgaaagaaagcatatattt

SEQ ID NO: 386 - DNA, 821 bp, Homo sapiens
  modified_base (67)..(67): a, c, g, or t
  modified_base (70)..(71): a, c, g, or t
  modified_base (73)..(77): a, c, g, or t
  modified_base (79)..(82): a, c, g, or t
  modified_base (179)..(179): a, c, g, or t
ttttttacaccaaaaagcaatataatattcacacgattagaatattcctgaaattgcatcttacagnttnntnnnnntnnnntatttataaaagcaattttaatagccaaaaactatgaacaacacaaatgtctatcaccattagaatgaatcctaaagttgtaatatattcatgaaanataatactacacagaaattaaaataactacaaatgaaacaactctgatgaacatcacagacataaaagaagtcatacatgaaatgcacacattgaaccaattatattaaatttttaaaataggcaatctaaacatttatttagggatgcatggttacagactaaaactgcaaagacaagtgattaccataaaactgaggatgaaggtgattaagcgttaaaatcaggaggggacataaaggagcttctggggtactagcaaagttcaatttcttaacccacataagttacacgattacaatgagttttactccattactgaccctgtcagttgaaaaggcctagaagcaatgacaccccagtagcaatgaacatacccagcacgcagatcttgatttccaaatgctattctccactaaaagaaatagaagtgcctggctccagcgttgaaatgagcctggaatatctgattgtgctcaacagcaaagaaatcactcaatggatgattaagtcatatcaaaaggacacaggatcagcttgaaggagctcccattggcctgatttaggacaatttgggcatcaatatgaatgatagtaaagaaatatacacactgaagaaaataagaaaaaaaaaaaaaaaaaa

SEQ ID NO: 387 - DNA, 501 bp, Homo sapiens
tttagtttgaaatttgcattttaatcagcgtttggctaacaatatgagataaactattagagaagtgtaggtcattctggcaaatagaaagttccatcatttcacacttagaaagctgccacgaagagcttattcttggagtataaaatgcagaatttaggttaagccagtcattttgtagatgaaattgtacactggcaatttcttatggttcaacctaatagtaaaacatttataaacaattgtatcattacaaatacatttagacatcgttttctgctaaactcagtattttcctttccatcctgatcaaagaaacattattgcagtaagccacattataattcagcacgatttcttctaaaaaggctccgagttcctttgagcttgttattgtacagtggatttttcatttgcaaagacgttaagccctccaaatgtgcaaatcatgaagtcagttgttgttccagcaaggtttgcccagcggtaaaaaacaagata

SEQ ID NO: 388 - DNA, 478 bp, Homo sapiens
  modified_base (12)..(12): a, c, g, or t
ccaattcatcancaatttatttttttccataaagtcaccaagctgccaaaacattcagtttggccatttaaaatcatttgaaataatggctttacatttttggaatttatttgtttatatatttatatttcattggtgcaaaagtgctttcaaagcagggattgctctcactggttgaggacatatcttgactccctaacgttttcactggaagttgacagagatgatatttaaaatgtataacaagtgagagcataggcacagaccagtcaggatggatgccaatcacaggtaaaccatggggctattccagtatacattagcagcatcttggtcctggcagtgaccatctcacgtgcatctcatccaggatctcttccttctcagtaaaagcgtgtccattttttccttcatgatctatcctttccatttgtactttgcatcccgttcccacaccagggacagcttgagagccaga

SEQ ID NO: 389 - DNA, 552 bp, Homo sapiens
  modified_base (29)..(29): a, c, g, or t
  modified_base (498)..(498): a, c, g, or t
gagagcttagatagagtgtatttttattnttttttttccatttccttttctcttttcatcttttttctttctttctttctttcctttttttcctttgtatttttatcttaacatgcctagacagagaagaacactggattgtacataatgggctttctttgactctcttttccagagtggaaataggattctgtgctccatcattctgagccatcaccaggggccgtccataatcaactatgatgatgagagtgggaagacatgtgtacatatcgcagcggcagcgggcttcagcgatattattcatgagctggcaagagtccctgagtgtaacctgcaggctctggatgtggatgacaggtatccatggtaaccagaaagtgctgggaaactagtcatttccccctaactgaatcttaaaataaaggagatgtttaaggaggtgtcctatacagctatatccctattgccagtaatacacatgggcttgtgacaatnaaaattgctctattttagtgagaggagaagatattattgttatggagaggaaga

SEQ ID NO: 390 - DNA, 896 bp, Homo sapiens
  modified_base (610)..(610): a, c, g, or t
  modified_base (612)..(619): a, c, g, or t
  modified_base (621)..(621): a, c, g, or t
  modified_base (784)..(784): a, c, g, or t
  modified_base (805)..(805): a, c, g, or t
  modified_base (808)..(808): a, c, g, or t
  modified_base (832)..(832): a, c, g, or t
  modified_base (856)..(856): a, c, g, or t
aagaggaaactaaaaccacatttattaatgctgtttaggtggagaaaagttggaaacaacctaaacatcaaaccataagagatgaggtaaacaaaggatgctgtagctatgtaaatgagtactcttacattacaattgctgtaaactaagcttgttgctctagaaagttgttcatataagatattaagtgccaacgtgttttatgaaagactatacatgatattgtgacactacacttacattaaaatatatgtgtacatattatatatgtatgatactatatgactaaatgatcatcttgtctttggggtaagtaggatttggaagtagctttttcttctttttatttgtctacacttccaaagtttttgtaacaagcatgtgctgctttgcaataatgaaaaatagcaatgctaacatttaactgaaaaaagaaaagcacaattatcctggagtagggcaggcactaaaaaggcgggagtaagagcgatgagagtagaacgctgagctgaggctggcctccttcacggccaccttcctccaggggtggatccgtgttccagtcacctccaaacacacaaagatgtcagtgccacagaccatactttcncnnnnnnnncnagtcaaagcaccaggaggggacagagtcaccacagtgcaagtctcagctgggattgggcaggggagaggagaagggcatcaaggagctgaccaggagacacactgatctggccaggcagcctcttgcagaagtggatcccgttaacaatgaaacagatatganatgaacttggcaacttctganaanaggattgtctagtggtgcttctancctaaagtgacccagtttcagatnagacagttttatccagaactcagaggggggaaaagattaa

SEQ ID NO: 391 - DNA, 1564 bp, Homo sapiens
  modified_base (156)..(188): a, c, g, or t
  modified_base (190)..(190): a, c, g, or t
  modified_base (192)..(195): a, c, g, or t
  modified_base (198)..(199): a, c, g, or t
  modified_base (201)..(203): a, c, g, or t
  modified_base (205)..(260): a, c, g, or t
  modified_base (262)..(262): a, c, g, or t
  modified_base (264)..(267): a, c, g, or t
  modified_base (270)..(274): a, c, g, or t
  modified_base (276)..(484): a, c, g, or t
  modified_base (547)..(564): a, c, g, or t
  modified_base (682)..(715): a, c, g, or t
  modified_base (971)..(1025): a, c, g, or t
  modified_base (1312)..(1336): a, c, g, or t
attcggcacgagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctgnnnnnnnnnnnnnnnnnnnnnnnnnnnnnnnnngncnnnngannannncnnnnnnnnnnnnnnnnnnnnnnnnnnnnnnnnnnnnnnnnnnnnnnnnnnnnnnnncntnnnngtnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggcagaagctctccggaggatccaggtggtgcatgcatttgacatcttccagatgctggannnnnnnnnnnnnnnnnnaggcactgtggcccagcaggtgactggttcttcaggaactgtgaaggtggtggttgtggactcggtcactgcggtggtttccccacttctgggaggtcagcagagggaaggcttggcnnnnnnnnnnnnnnnnnnnnnnnnnnnnnnnnnnctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccnnnnnnnnnnnnnnnnnnnnnnnnnnnnnnnnnnnnnnnnnnnnnnnnnnnnnnnttggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactnnnnnnnnnnnnnnnnnnnnnnnnnttgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccg

SEQ ID NO: 392 - DNA, 4259 bp, Homo sapiens; identical to SEQ ID NO: 312
  modified_base (104)..(120): a, c, g, or t
  modified_base (326)..(357): a, c, g, or t
  modified_base (956)..(958): a, c, g, or t
  modified_base (967)..(967): a, c, g, or t
  modified_base (998)..(998): a, c, g, or t
  modified_base (1036)..(1036): a, c, g, or t
  modified_base (1110)..(1110): a, c, g, or t
  modified_base (1114)..(1114): a, c, g, or t
  modified_base (1116)..(1116): a, c, g, or t
  modified_base (1149)..(1149): a, c, g, or t
  modified_base (1167)..(1167): a, c, g, or t
  modified_base (1296)..(1296): a, c, g, or t
  modified_base (1368)..(1427): a, c, g, or t
  modified_base (1430)..(1431): a, c, g, or t
  modified_base (1433)..(1433): a, c, g, or t
  modified_base (1435)..(1437): a, c, g, or t
  modified_base (1579)..(1579): a, c, g, or t
  modified_base (1606)..(1628): a, c, g, or t
  modified_base (1860)..(1907): a, c, g, or t
  modified_base (1965)..(1965): a, c, g, or t
  modified_base (2007)..(2007): a, c, g, or t
  modified_base (2189)..(2189): a, c, g, or t
  modified_base (2228)..(2228): a, c, g, or t
  modified_base (2351)..(2353): a, c, g, or t
  modified_base (2355)..(2356): a, c, g, or t
  modified_base (2398)..(2399): a, c, g, or t
  modified_base (2401)..(2401): a, c, g, or t
  modified_base (2486)..(2486): a, c, g, or t
  modified_base (2516)..(2516): a, c, g, or t
  modified_base (2566)..(2566): a, c, g, or t
  modified_base (2616)..(2616): a, c, g, or t
  modified_base (2651)..(2673): a, c, g, or t
  modified_base (2677)..(2677): a, c, g, or t
  modified_base (2683)..(2683): a, c, g, or t
  modified_base (2749)..(2749): a, c, g, or t
  modified_base (2752)..(2752): a, c, g, or t
  modified_base (2756)..(2771): a, c, g, or t
  modified_base (2931)..(2932): a, c, g, or t
  modified_base (2956)..(2957): a, c, g, or t
  modified_base (2963)..(2963): a, c, g, or t
  modified_base (2974)..(2974): a, c, g, or t
  modified_base (3062)..(3063): a, c, g, or t
  modified_base (3122)..(3122): a, c, g, or t
  modified_base (3328)..(3328): a, c, g, or t
  modified_base (3476)..(3476): a, c, g, or t
  modified_base (3481)..(3481): a, c, g, or t
  modified_base (3483)..(3506): a, c, g, or t
  modified_base (3691)..(3691): a, c, g, or t
  modified_base (3696)..(3696): a, c, g, or t
  modified_base (3730)..(3730): a, c, g, or t
  modified_base (3946)..(3946): a, c, g, or t
  modified_base (3968)..(3971): a, c, g, or t
  modified_base (3973)..(3973): a, c, g, or t
  modified_base (3975)..(3975): a, c, g, or t
  modified_base (3977)..(3977): a, c, g, or t
  modified_base (3979)..(3980): a, c, g, or t
  modified_base (3982)..(3984): a, c, g, or t
  modified_base (3986)..(3992): a, c, g, or t
  modified_base (4016)..(4016): a, c, g, or t
  modified_base (4024)..(4024): a, c, g, or t
  modified_base (4043)..(4043): a, c, g, or t
  modified_base (4066)..(4066): a, c, g, or t
  modified_base (4081)..(4081): a, c, g, or t
  modified_base (4102)..(4102): a, c, g, or t
  modified_base (4122)..(4122): a, c, g, or t
  modified_base (4127)..(4128): a, c, g, or t
  modified_base (4131)..(4131): a, c, g, or t
  modified_base (4144)..(4144): a, c, g, or t
  modified_base (4161)..(4161): a, c, g, or t
  modified_base (4170)..(4170): a, c, g, or t
  modified_base (4185)..(4185): a, c, g, or t
  modified_base (4187)..(4187): a, c, g, or t
  modified_base (4189)..(4189): a, c, g, or t
  modified_base (4209)..(4209): a, c, g, or t
  modified_base (4213)..(4213): a, c, g, or t
  modified_base (4218)..(4218): a, c, g, or t
  modified_base (4224)..(4224): a, c, g, or t
  modified_base (4227)..(4227): a, c, g, or t
  modified_base (4231)..(4231): a, c, g, or t
  modified_base (4233)..(4233): a, c, g, or t
  modified_base (4246)..(4246): a, c, g, or t

SEQ ID NO: 393 - DNA, 753 bp, Homo sapiens
  modified_base (83)..(120): a, c, g, or t
  modified_base (226)..(247): a, c, g, or t
  modified_base (448)..(463): a, c, g, or t
  modified_base (477)..(478): a, c, g, or t
  modified_base (480)..(480): a, c, g, or t
  modified_base (482)..(482): a, c, g, or t
  modified_base (484)..(487): a, c, g, or t
  modified_base (489)..(491): a, c, g, or t
  modified_base (493)..(493): a, c, g, or t
  modified_base (495)..(495): a, c, g, or t
  modified_base (516)..(516): a, c, g, or t
  modified_base (523)..(523): a, c, g, or t
  modified_base (540)..(543): a, c, g, or t
  modified_base (558)..(583): a, c, g, or t
  modified_base (722)..(722): a, c, g, or t
ttttttttttgtctctgggtagtcacgctagggctggcaggggaggaggcagaggaaaggcagggagaagagaaaacatcacnnnnnnnnnnnnnnnnnnnnnnnnnnnnnnnnnnnnnnaccagcccagcccacacagagggtctgaaaggttctcagccttctccatcacccaccctgcggcctctgaaaagaggggcccatctcagacacaaaagcagatacnnnnnnnnnnnnnnnnnnnnnnaacggaggaatactcacagcaccgtggcacgggacggcccttggcttcagagccgggctggcaccgtttgtaaacattagacctggtgatgtctggggatggaggaggagagggatgcccagcctggaccatcaggtttgatgaaagagacagggtggggcccctcaaggcctgggaaatgtctattagctatgggaaagnnnnnnnnnnnnnnnnggtgggggttgccnngnangnnnngnnnangntctgaatctacctgactatgnatttgcntgacttcagtgctaccnnnngaagtggccaggctnnnnnnnnnnnnnnnnnnnnnnnnnngtaatgagcacaacccctactcaggacagggtgctctgtggaagatggtgggcttctgtccataggcattctccaaaaagaagcagaactggatcttcttatgagaactacgactctttttccccgggattccagcctntgggagttgaaactggggaaagaaagaaggc

SEQ ID NO: 394 - DNA, 2868 bp, Homo sapiens
  modified_base (227)..(227): a, c, g, or t
  modified_base (300)..(300): a, c, g, or t
  modified_base (344)..(344): a, c, g, or t
  modified_base (354)..(354): a, c, g, or t
  modified_base (552)..(554): a, c, g, or t
  modified_base (556)..(560): a, c, g, or t
  modified_base (562)..(572): a, c, g, or t
  modified_base (595)..(596): a, c, g, or t
  modified_base (598)..(609): a, c, g, or t
  modified_base (611)..(611): a, c, g, or t
  modified_base (613)..(615): a, c, g, or t
  modified_base (617)..(627): a, c, g, or t
  modified_base (629)..(629): a, c, g, or t
  modified_base (631)..(636): a, c, g, or t
  modified_base (638)..(638): a, c, g, or t
  modified_base (690)..(690): a, c, g, or t
  modified_base (769)..(769): a, c, g, or t
  modified_base (1657)..(1657): a, c, g, or t
  modified_base (1716)..(1716): a, c, g, or t
  modified_base (1768)..(1768): a, c, g, or t
  modified_base (1792)..(1792): a, c, g, or t
  modified_base (2493)..(2493): a, c, g, or t
  modified_base (2495)..(2497): a, c, g, or t
  modified_base (2501)..(2501): a, c, g, or t
  modified_base (2503)..(2505): a, c, g, or t
  modified_base (2507)..(2507): a, c, g, or t
  modified_base (2629)..(2630): a, c, g, or t
  modified_base (2632)..(2637): a, c, g, or t
  modified_base (2708)..(2708): a, c, g, or t
  modified_base (2779)..(2779): a, c, g, or t
  modified_base (2785)..(2786): a, c, g, or t
gggagggctagtggaagacttaagatggcggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaaggttggagtgcantggcgcgatctcggctgactgcaacctccacctcctggattcaagctattctcctgcctcagcctgccgagtngctgggattacaggcatgtgccaccgcacccagctaattttgtnttttttagtngagatggggtttctccatgttggtcaggctggtcttgaactcctgacctcaggtgatccgcccacctcagcctcccaaagtgctgggattacaggcgtgagccaccgcgcccggccagaacattagttttaaacttcctaacccttgggagaaggcaaaacacttgatgaaatctacataaagactaaaacattttannnannnnngnnnnnnnnnnntttgaaattgcattgacgactgnnannnnnnnnnnnntnannnannnnnnnnnnngnannnnnncntcattcctgagtctcctgtaccactgagaataggctggagtgcagtggcgcnatctcggctctctgcaaccttcacctcccgtgttcaagtgattctcctgcctcagcctcctgaatacctgagattacangcatgcaccaccacgcccgtctaattttgtattttcactagagacggggtttctccatgttggtcaggctggtctcgaactcccgacctcaggtgatccgcccgcctcagcctcccaaagtgctgggattacaggcatgagccaccgcgtccagcaagaataggtgattttcaaacttggaaacattcagaagttatcgcctcagtttcagattgagtagtctcaaagagattacagacatctaccacaaattctctacttggtgtggtgcaaaatcagtatgatgtaaactttgtctctcagtttcttcaaaggaaagaagcaactggaacacacatataacactaacccttccagctgcattatgagggaccagtacctgtctcaaggcaaaattatgacttagttcatcctcacctctggaggccagtaaaagtgggttatagaagaacaaagaggcatctagatctttcactgggttatttggagagaaacatctcctaccgaaggccagtttaacaagactggtagaggaggttatcttatctaattcacagaaatcaacacattgagtcaagaaaaatgaaacacagaaacactctaaataaaagaagataagtcttcagaaaccaaccctaatgaaatgaagatatgtgattaacctgacaggaaattaaaaagagcaaccataaagagtctcatgggagcaatgcatgaacaaactgagaattttcataaagaaataaaagataacaaaaagtataaagttgaagaatacaataactggactcaaaaatttaatgtgtccaacagaagaatcgatgaagcagaagaaagggctatcaaacttgtagataggccattggaaatcatgtaatgtgaggaganaaaaagaaaaaagattgaagatagtttaagagacttttgagacatcctcaaaggggaantaatttatacattaccagatggagaagatagagggaaaaggacagaaaacantatttgaagaaataatgtcagaanaacctcataattctggcaaggaaatagaaatttagatctaagaatctcgaacatcaggtatgatgaatccaaggagactcacaccaaaccatattgtaattaaataaaggttaaagacaatcttcagagcagcaagggaatagtctcttcttacatacaaaatgatccacggaagactgtcagcagacttcaccagaaaactttcacgccagaaggcagtcgtgatatatacaaaaagctgaaaggaaaacactgccatccaggaatactatctccaactatcctgtgtttcaaaaattaaggagaaatataaagttctcaaacaaaagatgtgggagtttaccaccactagacctgcacgggaagaattgctaaagggagtccttcaagctgtagtaaaagagtgctaattagaaacatgaaaacaaatacaaaaaaaattctaaaacttgtatggaactacaaaagacattaaataatcaaagtaatcttgagcaacaaggacacagctggaggcatcactctacctgattttgtaatccattatcaaaaaactgtggtaccagcataaaaacagattcactgaccagtggaacaggaaagcccagacataactcatacatttccatccaattgatttttgacaaaagtggcacacagaatggggagaggacaaataaataaataaattgttttgaganannngtanannnanatgtgaaattgaaccattttctcatagcatatagaaaaatcaactcaaaatggattaaagcctgaaatgttgcctttgaaactgtaaaactactagtagaaaatataggggaaaagctctannannnnnntctgggcaatgatttcttggatacatccttaaaagcatgggcagcaaaaacagccagacaactatcagggnacctgcccagatagtcacataggttcttttctattttccctaagcattggccgggttgagaaataaagggncagagnnccaaaagaaagaaattttaaagcttggcattcttgggagacaatacatgtcggtagggttcgtgatgccccccgagccgtaa

SEQ ID NO: 395 - DNA, 1522 bp, Homo sapiens
  modified_base (692)..(696): a, c, g, or t
  modified_base (698)..(698): a, c, g, or t
  modified_base (701)..(705): a, c, g, or t
  modified_base (719)..(720): a, c, g, or t
  modified_base (810)..(810): a, c, g, or t
  modified_base (1033)..(1033): a, c, g, or t
  modified_base (1036)..(1036): a, c, g, or t
  modified_base (1376)..(1376): a, c, g, or t
ttttttttttttttttttttttttttttttcttttaaaattcatttataaaaataaattttagtttgagaccctaggtaccaaattgtggcttaatttactcaagatggatgtactacaaagttatgaaaaatgtagctgaaaacccatgagctccagctcatttctgcagcgtggccaacagctgccactgtacactgtcacaacccttctcataggtaaccaaaatacgctcaacgtcttgacaaacttttagccttcctttgtcctgaaactcccacacaactttaattcttagacctccattataaaactattagtaaccataatacattcaagatagagaatgaagacctgtcatccactcaggagacactgaaccagggcactgggacaacacggccactcaggggaaatagtcacccttgtgggtgtacagctcttcagatgttttgcactagaatgcaggcaaaaagtcccttatgtaatttttatctccaagcaacaacatttaaaaatcagttgaagagtgtcagcaggtgcttctaggttctgtgctgtgagcccccaggtcgtggagtgtagggctctggatctctctgtacacgggatagaaacacagtcacgtggaaatgccaatatgacttactgcttagggctgtgctgacatcggcatctctgttagactgattnnnnnangannnnntttttttttttttnngccttagtcaggagattattcgaggaacagtaaagaactgaactaaggaagtagctactggcttccaaagccacacacacacaaaagtangtttcaaactgttgtcctctctcagtgcaaacgagcaattggcggacctgtcacgtttcatcaatcgatacgaacacagcattcagtctgtggaacaatgtgatgcggcaaaaatctgatctaatgcaaattcaagcccattaaataaaaccacagaaaggagagccagcccggctcagtgtcctcgcgcacggacgctgactcgtagcacaaaagcagctgnaanggcacgaggctcagatctcactgatcgtcctctctgaagggcagtactccgaggggcctggcgaggacatgtagaaagactgcgttttccttttcaatcgggcccttttgttggccaacaccagactgcgccggcttgaactgatgatttccgaaatgaacttcttgcagtccacacacacctccatggtgctccagtcctccatcaactctttgggaaactggagttcttcatctgatttgtccatagacttagattttgaggagaacctggcaatgctccgaagtggccgatgatgggcagtggagggtttttctgacctcatactactttcccctcntttgcagagcagaaggtcccaatgaaaagataggaagagtggagtatggtttggagggcagccgcatctttttgcaacactgtgagcacaccggcctcttacagaactgacaggtataagaccaagtgaagaaggaaaacctcccc

SEQ ID NO: 396 - DNA, 1889 bp, Homo sapiens
atggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctgggtagtccatgatggtaagtcatagaactctgccctctgcacttcagcccatgacctcaggatggcctgattggctaccctgctctccagccaatccagtgcaagctctcatccgagattcactgaagtggtccatatccatctggcagcatcttctagttctgtcggggtgtcaaaaggatttgtatatttgcttctagaatgtgtatagcatgaatactaccaaaggagacgacaaacttgcagcttaaaatgggcaccagttcccacactggcttaatttatataactgcttggctgtattgcgggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctga

SEQ ID NO: 397 - DNA, 2244 bp, Homo sapiens
gggattgtgaatgaagaaagtgaagttttcctcccacacaggttcattggttttgtatcgaatcttgctctcctgggccttgtgcccaactgacatctggacaacaggatttgggttgctgcttattttcttccctgactttaaagctctctgaactgcagtcttcttcaagacatcggggttaaattctaatgggttactcggaaggttccttgctgaatccaagtacaagatcagcaatgcagaggaaagaccatcgttggcttggtctttgtcagctttgatgtctgttagcaccttgtcgaggtttgacgcatttggcattaacgtgagccactccagtctcaagtgtagcttccccttgggaacctcgtccagagtgaaccattcatctaaaaggcgctccttttcaacttcaatgaggtcaatcataagacttcctaaaaagtcatccttgtctgggtcttcatcaaagagctcaatctctaattcttgtccaggatgttcatacactaaagcctcatagacttcattccactttggactgaggttctccttgatgactctgctttggaagatttggttgccaactctaatgattccataggggtctgactttcccttgacaagtcccttaaggtaagtgtctttcccctgaagatcctgagcttcaataaaatgtatccttagaacaccctttggtacaggaaaccgcaactgagctatttgaacttcactgacaagtggaacggtgattcgattgggaagcaccagatagtttgatattatatccaaaatgatagtatctgataaaccattcaatccagggacatccagaagattcgtcagtcctgtccagttaatttctaaaagtggtttcctaaggaagaagatagacaaagctccaactaagggcatatctccaatcaacggttccaggatcacccgcatggtaccatgaatctggatacttttcacaccagctctacaaaaatatcgtttgatctccaaatcaatctcacaatttcctacaaaactaatctgaaggtccaaaataatttgccttttgtctacattttcagtgtataccttaacaccattgatcctgaggggctgctggcccacgtcgaccttcgtgaaactaaaggtgctaaggtgggtgtttgctccccgcacggctggttctatagtttctcgaaacaacttctctataaattggcaaatgaaaggccacatgtgttttacagtcttatttagccattctgctctttcagtgtctggaaaatgaacccaggcgggcaggtcgcaggcgcgcacccccaggcgcacgacgcgctcctcgtcttccagcagcgccagcgcgcggcacaggcgcagggccttgaggccgcggctgcggcgacaccaggcgagcagcgcgagcgcgaggagaacccagctgaagctgagccccaggtagcccagcgcgtacacgggcagcagcagcgcgaagctccgcgccagctgcgccagcagcccgggcagctccacgctcagcacgcccccggggttctcaggcgccgcgcggcccccagccccgccggcgcccgcctccgggccctcgccccgggcgccgctcatcgccccgcagtgccgcgctgccctcccggccgaggcgggctgggtgctcgcgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataccaaaaaaaaaaaaaaaaaaaaaaaaa

SEQ ID NO: 398 - DNA, 3186 bp, Homo sapiens
agttaatatgatcctctgttgaagcaagaagacaaactgtatggtggagaaagaagtgggaaggatctgcgcggaagaagcctgagaagatgatgcacagatagagaggcaccaggacttgagaggcaccaggacttgggaggcatgttgatccatctccaggaaagactgagaaaaagagcgttgaatataagaaaaaatacttcctctgttctcagatcgtatttgttttaaggccacacctttttgaagttttcagtttgaaacacaacctggactgaaatcatgagggaggttgtgtaggaaagaatcatcaagggacttagttgggagcttctctaccacagcttactccttatggtattaaccccctttaagtgtaaatgtctttggtttaaaacgtttgtacctcatctgttaccagagtgttcatactggagagaaaccctatgaatttactgaatgtgggggaactgttactcatatgttgcatttcgtcgaacgtgcaagtcatgctgaagagaaaccctgtgcttctaaggagtattgacaagcccttagctagatgacaatctcattgagaagcagaaaattcatgctggagagaaactagtgaaggtagcaatacttcattgaatattagaaaatttttctagagagaaagcattgaatatactgagtatgataacatttcctctcaaaccttatcccttactctgcatttgggagatcatacacagagaagccttataaatgtaagagatgtggaaatatcttcagccaaaagtaaatcctcactcatcaagaaatttttactggagagaaaccttgtgaatgtgggaaagcttccattcagatgtcacacctcagccagcagaaaatttacagtggggaaaacccctttgcctgtaaggtatgtggaaaagtcttcagccacaaatcaaacctcactgagcatgagcattttcacacgagagagaaaccttttgaatgtaacgagtgtggaaaagcctttagccaaaagcagtatgtcattaaacatcagaacacccatactggcgagaagcttttcgaatgtaatgaatgtggaaaatcatttagccagaaggaaaacctccttacgcaccagaaaattcacactggagaaaaaccttttgagtgtaaagattgcgggaaagctttcattcagaagtcaaacctcatcagacaccagagaactcacacaggagagaagccctttgtatgtaaggagtgtggaaaaaccttcagtggcaaatccaaccttactgagcatgagaaaatccatattggagagaagccttttaaatgtagtgaatgtggaacagcctttggccagaagaagtacctcataaaacatcagaacattcacactggagagaaaccctatgaatgtaacgaatgtggaaaagccttctctcagcgaacatcacttattgtacatgtgaggattcattcaggtgataaaccttacgaatgcaatgtttgtggaaaagccttctctcagagctcatctctcactgtgcatgtgagaagccatacaggggagaagccctatggttgtaatgaatgtgggaaagctttctctcagttctcaacccttgctctgcatttgagaatacacacaggtaagaagccttatcagtgcagtgaatgtgggaaagctttcagccagaagtcacaccacattagacaccagaaaattcatactcactaaaaaccccatgaaagccttgaaagtgggaaagctttcattagaaatttgcacctcatcatgccccagaaataatccttctgaagcaaagcaccacgaatgaggttaactttaacaagtactaaaaacttaagggacaccagaaaatttgtactgaagagaaagacatgcatatgattaaaaccctgtgtccaacagagaaacctgcagcagagataatggtgaaagtttaggcacattttcactaaaagtgggaacagaaaatggaggcctgttttttattgctaccaccatagatctggagatcttcgccagtaacaagaaaaattaagttgtaaatattggaaaggaacagacaaaaatagatgacatggtcatctacaactaatattaagactcctgtggtattgattgagcagagcagaagagatttcaaaaaaagacctatgcatttattagaatttggaatatgatacaagtggcatcaggaaatgaggaaataatggaactattttttttaagtggaggtagtttgttctccaagggggaaaaatagaccatgaactatacacaaaagtgaatccagagattaaaaacagaaatatggaaaagctatgtactaaaatgcatatgaccttgggaatagggaaacattccttggaacaatttgagaaatacttagcggttctacttatgagtatgaatgctcaggaaatacgcactaggatatttactgtggcttgatttgtagtagccaaaaattagaaacaactgagaaagcccatcacgaacaatatgggaaattcttatgtaatactatatatctgtaaaatgcaacaaatgaaatccacatgtattaacagaaagatcccagaattgttgaggggggatcaagttgcagaatgatacagatagtacaatgacttttttgtaaatttgaattaaaagtttcctcataaaactcagtactatctattggtaatggatgcatatatgtatgtacatgtacatgtttttgaaacggattggaaggatacagaccaaactcttgatagtggtcacctgtgaagagtggagaagggaaaataatgagtgtgggaggtgggatgggtattggttaaaggggacttcagctttttatataaacatccacttctctttcaaaagacttcaagtaaatataagaagatactgattgattctggattgtggtatagggatatcttgtcttattttttgtacttttctgtatttttaaaatttctcaaaataggaatgggagtgaggatgggaatgctgtatctgtggaagtcatgttatactggattcatttccaattaaatactaaacattttatagaaaatatttctaaaattttatcacggatgaatggatggacttgctctctatgtaatatgaaattaatctattttattaaaatttaaaaggacagc

SEQ ID NO: 399 - DNA, 5581 bp, Homo sapiens
agctcctgtgacagacggagctggagcggcggggcggcggcggagtccggcggccgggagagcgagtgagcgagcggaggagcagcgacacgggagtctagggagcgagaaggagaaggaggggagcgctcgggcgcgagcgagagaaaccgcgagcgccgagcttggactcgagccccggaacggctgaggagcccgcccgctcccctcccctccccctccccgggcccgggcccagcgcgccatcctcccccctccttccctccctccctccttcctccctcccctctccctccccctcccccgccggtggatgggagtgaaggacggaagaggcccggcggaggcggcggtgcagcgctccggtggaatgaatcttacttgttgaatatcttctggttactagttggattcatttgtgaaagaatcattttcccctgtgtggaagacacttagtggcatatttaaattataagtccacggatcaaaaagctttttgatttcccaaaggagggacataccactatatcagataagcttgacattacagccaagatggtgctgtcccagagacaacgagatgaactaaatcgagctatagcagattatcttcgttcaaatggctatgaagaggcatattcagtttttaaaaaggaagctgaattagatgtgaatgaagaattagataaaaagtatgctggtcttttggaaaaaaaatggacatctgttattagattacaaaagaaggttatggaattagaatcaaagctaaatgaagcaaaagaagaatttacgtcaggtggacctcttggtcagaaacgagacccaaaagaatggattccccgtccgccagaaaaatatgcattgagtggtcacaggagtccagtcactcgagtcattttccatcctgtgttcagtgttatggtctctgcttcagaggatgctacaattaaggtgtgggattatgagactggagattttgaacgaactcttaaaggacatacagactctgtacaggacatttcattcgaccacagcggcaagcttctggcttcctgttctgcagatatgaccattaaactatgggattttcagggctttgaatgcatcagaaccatgcacggccatgaccacaatgtttcttcagtagccatcatgcccaatggagatcatatagtgtctgcctcaagggataaaactataaaaatgtgggaagtgcaaactggctactgtgtgaagacattcacaggacacagagaatgggtacgtatggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgagactaaaaaaagtggtaaacctgggccattcttgctgtctggatccagagacaagactattaagatgtgggatgtcagtactggcatgtgccttatgaccctcgtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttggatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaaaagtggtggttattagggcttttcctgaaatgtgtatctatgtaacatcacttaagtgtgcttaataaatctcctgtaaggattttagatgataaggctacaattcagaatcttctgaaccatctatgtaatgaatggggattatacattggaatttttgtcatgacacatttgccaaatcagtaggatatatttgttttggcagcctatcacgcagaggctagtggtatatttatgtaagaaaatgactgtaaatctcaagaaaaatctcagcagctaatagcaactcatttatttcattttggtcttaatgctttgtaaacaggtcaaaaaatactgtcatactctaagcttctattttccacactggacatacttctagttgtattctccatactattagactgtgtagtgatgtgacttccaagtagaatttaatctccccattgagtgtgtcatggtacaaatcactattcgtttttggtgttttttagggatgtgcaatgtgcattacataatgacagaaatactgagaaggttctgtgtgcccatttgaaaggagtgggaggaatacagcagtttgtttttcaacatgaatctgatattgatttaaactgtgtttcacttacaagttttaaaaaaatgacagggtttaatggagcgtgcataaaaatgtactgttttcaccttttgtttatatgtaaatgtttgtaagtatatgggcctatctgtaagtgggtaagtctgtatgtgtgtatcatacacatcaacctccatgtccttagtcctgggtttttgaaaaagtgctaaaacggacaagtagaataaatgttgctgtggaatgccatgctttagaacaaaccctttttgatcttaatgcttctgaaaactaggtctgactctggggatttttttccagccgaaggaaaatcacttccgttatgtccccctctaatttagccgctcgacattttacacaacccggatatgttgtatattttgacccaaagttacaggtaggtttaagagaatttttagccatgacttttggagcactattccattgtcagttattaataaagaattccattgcttagctaaccaacaggttttttttgtttccaagagagttatttgaaaagttaacagaacaatgagataacagtgacagtttaacaaagataaaattctgaactgcgttttattcatttgtgtactatgtgattttttaaatgtcccctttagtatttaatggaaaattggttcctgcaaaagacaaagggtgagagttagcgtcctgtagatacacacagagactaggccgtatattaactagaagcagctttatgtctagcttgtgtctttttgtttgtttgcttgtttgtttttagattcctgagagatgtctctggaagggaaagttttgagaactaatggctatttttgaggacaaaaattacatcttaagctaattccttaaatacatacagtaggtgaattttcaggacaatattgcctcacaaccctgcttacattgaaaagtctttttcccttagctcttctgactggatttttctacaaaactatggaaaatatctttgttcttgtttgctgctattttctgtcctattttgagaaatataaatacatagaaatggtgcatcttaacatttgtttgtacatgtataaatgtcttgtattttaattcatttttagcatgaattgtttaagggtaagccacaacatctagaaatcactcatagatattgaacaataaaggagaatggtaccgatgcaggaggaagcaagcgtgtcttcccctgcagcacacagcgacttgcgttgacaaaggaggaggaaacgattactctgtaaacaaagttatccttacttgggagattgccacagcctgctgctgagttgagttaccagacatcctccatgtgagaagcagcgaacattgaatctcagggatggcccacaactgggtccacatgtaatgagccctgtttaataacgaaggggtgggggagagcagtccgtctacaacctggaatcagatttgcaaaatttcctgcactgctgtctgacactgtcctgttgatgccctttctgactgtgttctctgttttctctgtctgctgtctaaccctgtgccttgcctgggataaggacaatgatgaggttactggtttggattgtaagtagaggacttttattaattggtttagaggttcactgctgctttgtcactttctcaatcaaattggccacttaagaaataaagagctggtagaattgcatcctcagatgattattgactgtgtgtgtgtgtgaaaacagacattccagtgccacccaaatatatatctgtaacgtgcccaagaaatcctagctgcgctcttgagagtgcatgccatggagactggtttagacaccgcgtggagcctagttgcctgttgtcacggcatcttgcactttaggagactaagaccgtcctggttcgtctgtgtgtggtgtgaccaatggtgtgcccagagcactactctcaaaatcactagtgttagcaagtcgtcccgggctggggagcgttcgccgtagtctttggaagctttggctttagatttaccaagccccgcctccccgctgccagtgccctgctctcccgttcgcctctttctgtttctgtgtgaactttcccggtaatatcactcgttaaataggttttctttaaacttaattaaggaaaaactatttaaaggtaaaggatattttgttgacatcggtggctcgatcatccttaagcaactgaagttaaaattgttgaaggaaaaggcacttaaattggttactttcatgtccagctgtatataagtccagtgtgttcatctagatgacgcaaagaatctcctggtagagaagcgacatgtaaaaaactggtggaaaaaggttttggattttttttccagtggggtggggggagggcaagctggatttacaggtcacggctggactgaatgggcctttttatcttcccactgtatcatggaagtagctgcttgcttgtactgtccatccttcaggcatccctaaagctcactctgaagatgttagagacaaacacaaactcttcgagttaaagttgatcctgacactgacatgaaggcaagccttgatttcgtatgaacgttgctgaagtggtaattgaggaaaacagttccccagattgttaagagttcactgaagatattgacacaattttaaaaaatcagtaaaggaatgtatataatattgctctcgtgttttacagtaagatttgttgctctcagactgtgtaaaacaaaatttattcatgttttctgcatattaaaaaatcttattgtaccaactggtaaaccg

SEQ ID NO: 400 - DNA, 737 bp, Homo sapiens
ggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagcgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagct

SEQ ID NO: 401 - DNA, 3115 bp, Homo sapiens
ccaccatatcggtcccgtatttcacattgataaggtcctgtttcatttctcgtgacattgggtagaatgaggatcctgttttcaatgggtcgctttaccctgggactgacagggaggctctgaccatttagccaccaaatgtaggtgtagttctcactcttaggttcaccccgcggccgatcgtcccccatacctcggccatgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcacagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggagcagatcaatatcaccctggaccaccgctgccgtatcttccagaacctggatggagccttggatgaggtcgtgctcaagtttgaaatgggccatgtgagagcgaggaacctggcctatgacaccctcccggtcctgatccatggcaacgggccaaccaagctgcagttgaactacctgggcaactacatcccgcgcttctggaccttcgaaacaggctgcaccgtgtgtgacgaaggcttgcgcagcctcaagggcattggggatgaagctctgcccacggtcctggtcggcgtgttcatcgaacagcccacgccgtttgtgtccctgttcttccagcggctcctgcggctccactacccccagaaacacatgcgacttttcatccacaaccacgagcagcaccacaaggctcaggtggaagagttcctggcacagcatggcagcgagtaccagtctgtgaagctggtgggccctgaggtgcggatggcgaatgcagatgccaggaacatgggcgcagacctgtgccggcaggaccgcagctgcacctactacttcagcgtggatgctgacgtggccctgaccgagcccaacagcctgcggctgctgatccaacagaacaagaatgtcattgccccgctgatgacccggcatgggaggctgtggtcgaacttctggggggctctcagtgcagatggctactatgcccgttccgaggactacgtggacattgtgcaggggcggcgtgttggtgtctggaatgtgccctatatttcaaacatctacttgatcaagggcagtgccctgcggggtgagctgcagtcctcagatctcttccaccacagcaagctggaccccgacatggccttctgtgccaacatccggcagcaggatgtgttcatgttcctgaccaaccggcacacccttggccatctgctctccctagacagctaccgcaccacccacctgcacaacgacctctgggaggtgttcagcaaccccgaggactggaaggagaagtacatccaccagaactacaccaaagccctggcagggaagctggtggagacgccctgcccggatgtctattggttccccatcttcacggaggtggcctgtgatgagctggtggaggagatggagcactttggccagtggtctctgggcaacaacaaggacaaccgcatccagggtggctacgagaacgtgccgactattgacatccacatgaaccagatcggctttgagcgggagtggcacaaattcctgctggagtacattgcgcccatgacggagaagctctaccccggctactacaccagggcccagtttgacctggcctttgtcgtccgctacaagcctgatgagcagccctcactgatgccacaccatgatgcctccaccttcaccatcaacatcgccctgaaccgagtcggggtggattacgagggcgggggctgtcggttcctgcgctacaactgttccatccgagccccaaggaagggctggaccctcatgcaccctggacgactcacgcattaccatgaggggctccccaccaccaggggcacccgctacatcgcagtctccttcgtcgatccctaattggccaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggccggaacacacctttatggctggggctctccgtggtgttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtgagaagccatggccagagcttctcccaggcacaggtgttgcaccagggacttctgcttcaagttttggggtaaagacacctggatcagactccaagggctgccctgagtctgggacttctgcctccatggctggtcatgagagcaaaccgtagtcccctggagacagccactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctattaaaggtcatttaaaccac

SEQ ID NO: 402 - DNA, 3512 bp, Homo sapiens
cgagccacccagctgagaggagaggcgcccccggggacgcactgagattatgaggctctggcctccactggccactcactcgtgaccctttccaccacggcggagccttccaagcctacctcctgccgtgtggtgatctacctgcagcgggagatgtcgggggacacctgcctgtgcccagcctcaggggccaagcccaagctcagtggcttcaagggaggagggttgggcaacaagtatgtccagctcaacgtgggcggctctctgtactacaccactgtgcgggccctgacccgccacgacaccatgctcaaggccatgttcagtgggcgcatggaggtgctgaccgacaaagaaggctggatcctcatagaccgttgtggaaagcactttggcaccattttgaattacctccgagatgacaccatcaccctccctcagaaccggcaagaaatcaaggaattgatggctgaagcaaagtattacctcatccaggggctggtgaatatgtgccagagtgccctgcaggacaagaaggactcctaccagcctgtgtgcaacatccccatcatcacatccctaaaggaggaggagcggctcatcgaatcctccaccaagcccgtggtgaagctgctgtacaacagaagcaacaacaagtattcctacaccagcaactctgacgaccacctgctgaaaaacatcgagctgtttgacaagctctccctgcgcttcaacggccgcgtgctcttcatcaaggatgtcattggtgacgagatctgctgctggtccttttatggccagggccgtaagctggcagaggtgtgctgtacctccatcgtgtatgccacggagaagaagcagaccaaggtggaattcccagaggcccgaatctatgaggagacactcaacgtcctactctatgagactccccgcgtccccgacaactccttgttggaggccacaagccgtagccgcagccaggcttcccccagtgaagatgaggagacctttgaactgcgggaccgtgtccgccgcatccacgtcaagcgctacagcacttacgatgaccggcagctcggccaccagtctacccatcgcgactgaccagaccctcagggagtcagggcacgggaggccctatctcccatcctgtggaacccgccccattggccaccccatgctgctgctgcctgggtctctgctctagcacccagaggcatgacaggccctgctcagaggtcagagggtctgggcagaggagggaccacattcccctgccttgcccctgagcacttctggagactgcgtcctgtcctatctgctcaccatcacccttcctgcccgacggagctgcttctgctccctggggcatatggactgacccacctcctgctgagaaccttcccctaggccctgtgcagaagggctactgccccttaggcctcagctgggggaaaggcagttctggtgctgtagaggccctggtgcagaaagtgggacgtcctttttcctaaggtgtttaagcacaggcttgataagtttggtttttaaaaaataatctaggaaatgaataattctaaatctagtaatgaggaaactgagcatttcttttgccctccagggtgccaagaccctacatatgacagaacccttggcccttctccatgcctgtgggatctgtttctttaaagcactttgtactgttattcaggaggttgataatctccttgacccatgtctttctaccctaatccccacttccctgcagaatcaatctgagggaggggataaagaggaagcaataaaaaaaaaacatccgacagagcagctctggctttgccagcctggccagcagctcagagtgcaccgaggagggaaggatggctaagctgggaccggcagtcctcacagggtgcctgtgagaaaggacattttacccccacatcatagtcacatcactgactcctaggtctagcacgactgctctttgtgatcctcttgagtacccttggcttccagccatgctgtcctcacatacggtaaagccaaagagctgtcacatgggccagaaacatgagccacggcaggaagaccgtggagcccgtgggcactgcatggtgttggctggcatgcccatcagctgaggacagcaaactcccagcagcccctacagaggtggcacatgcttggccacacatctactccctgcccacaccatctatgctcttggttggtgctggctgggatggcggttctgcccagtggtgtctctgagcgcgggatgacaggagcaaccgaagcaccctgaaggccttcactccttgttgggtaactcagccatggagatgccaagcactagccaggaggtgagttcctctttagggctttggttttcattcctttttgtttggcttggccaaaccagaattcagcttatctgaattattttccaaaggaatgctgtcagggagggactgttctgccagcctaacaaagcaacgtagccacgtatagtacccacttctgctctttggagagaacacaggttatcaagttcatctctcttgactactcttatgatagctgatgccacagagcctatgggcaaatgccagacccagggttagacacaaggacctgaagtgacatgacggcgggacaggggaaatgtgactttctaattaggcattttatgttagtcacagtcttgaatgtataaacagcactaagactctcaggtcaggtaccttggtgatcagctactagttcttccagccctcattgaggtaacaagataaagacaaatccacttctttggccaaattcaggctttggctttatgactttcccacagagactggaatgcgtcagcctgagaccactggcctattttctcagctgccctcttgaggtcctttaacactcaaattcccagctccccactgaggtgttgtgatgcttgccttttgacctccccatcccctttagtccctgcttactactttgacattcacatcctcagtgtctcagtcttttttgccgagaaagcacagtagtctgggactgggcatttatcttctctgactgaaaatctctccttggtcttaaggaaaatactaacattgaactcactgacatgatcttagcttctttaatcagactttgtgacttaaaagtttgggggttttctttgaaagtttccagccctattcagaaagcaactcttggctgtgtgcatttttcaactccaagcagcccaggggtaagtaaacaaagtatggatgaaggtcagattttcttgtcagtttctgagaaacctggcagcctgctgttaacaacacaggccagtattgggttttattgaatttggtatgtgaccaaggtcggcctaaaggatggcgcaggtcctgggcaggaaagaatttttcctttatcacataactgtaatatttggttgctcagcataagtgatggaagcaaacactaatttctaataaaattgtgttaaactc

SEQ ID NO: 403 - DNA, 1370 bp, Homo sapiens
ggcggcggcagctgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtg

SEQ ID NO: 404 - DNA, 3088 bp, Homo sapiens
acaaaaaagcttttacgaggtatcagcacttttctttcattagggggaaggcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtggtgcccaggcaacatgggtgactggagcgccttaggcaaactccttgacaaggttcaagcctactcaactgctggagggaaggtgtggctgtcagtacttttcattttccgaatcctgctgctggggacagcggttgagtcagcctggggagatgagcagtctgcctttcgttgtaacactcagcaacctggttgtgaaaatgtctgctatgacaagtctttcccaatctctcatgtgcgcttctgggtcctgcagatcatatttgtgtctgtacccacactcttgtacctggctcatgtgttctatgtgatgcgaaaggaagagaaactgaacaagaaagaggaagaactcaaggttgcccaaactgatggtgtcaatgtggacatgcacttgaagcagattgagataaagaagttcaagtacggtattgaagagcatggtaaggtgaaaatgcgaggggggttgctgcgaacctacatcatcagtatcctcttcaagtctatctttgaggtggccttcttgctgatccagtggtacatctatggattcagcttgagtgctgtttacacttgcaaaagagatccctgcccacatcaggtggactgtttcctctctcgccccacggagaaaaccatcttcatcatcttcatgctggtggtgtccttggtgtccctggccttgaatatcattgaactcttctatgttttcttcaagggcgttaaggatcgggttaagggaaagagcgacccttaccatgcgaccagtggtgcgctgagccctgccaaagactgtgggtctcaaaaatatgcttatttcaatggctgctcctcaccaaccgctcccctctcgcctatgtctcctcctgggtacaagctggttactggcgacagaaacaattcttcttgccgcaattacaacaagcaagcaagtgagcaaaactgggctaattacagtgcagaacaaaatcgaatggggcaggcgggaagcaccatctctaactcccatgcacagccttttgatttccccgatgataaccagaattctaaaaaactagctgctggacatgaattacagccactagccattgtggaccagcgaccttcaagcagagccagcagtcgtgccagcagcagacctcggcctgatgacctggagatctagatacaggcttgaaagcatcaagattccactcaattgtggagaagaaaaaaggtgctgtagaaagtgcaccaggtgttaattttgatccggtggaggtggtactcaacagccttattcatgaggcttagaaaacacaaagacattagaatacctaggttcactgggggtgtatggggtagatgggtggagagggaggggataagagaggtgcatgttggtatttaaagtagtggattcaaagaacttagattataaataagagttccattaggtgatacatagataagggctttttctccccgcaaacacccctaagaatggttctgtgtatgtgaatgagcgggtggtaattgtggctaaatatttttgttttaccaagaaactgaaataattctggccaggaataaatacttcctgaacatcttaggtcttttcaacaagaaaaagacagaggattgtccttaagtccctgctaaaacattccattgttaaaatttgcactttgaaggtaagctttctaggcctgaccctccaggtgtcaatggacttgtgctactatatttttttattcttggtatcagtttaaaattcagacaaggcccacagaataagattttccatgcatttgcaaatacgtatattctttttccatccacttgcacaatatcattaccatcactttttcatcattcctcagctactactcacattcatttaatggtttctgtaaacatttttaagacagttgggatgtcacttaacattttttttttttgagctaaagtcagggaatcaagccatgcttaatatttaacaatcacttatatgtgtgtcgaagagtttgttttgtttgtcatgtattggtacaagcagatacagtataaactcacaaacacagatttgaaaataatgcacatatggtgttcaaatttgaacctttctcatggatttttgtggtgtgggccaatatggtgtttacattatataattcctgctgtggcaagtaaagcacactttttttttctcctaaaatgtttttccctgtgtatcctattatggatactggttttgttaattatgattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtataaacat

SEQ ID NO: 405 - DNA, 2908 bp, Homo sapiens
atgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgaacagaggaggggaaagcaccaaccatggcagagtccagaaaggcctctcagcaggctcagtccagagcgatcttcagactccgagtcgaatgaaaatgagccacaccttccacatggtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataagccccgacacgtctctgctactggactgtggtgagggcacatttgggcagctgtgccgtcattacggagaccaggtggacagggtcctgggcaccctggctgctgtgtttgtgtcccacctgcacgcagatcaccacacgggcttgccaagtatcttgctgcagagagaacgcgccttggcatctttgggaaagccgcttcaccctttgctggtggttgcccccaaccagctcaaagcctggctccagcagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttgggctcccacataagcactagtctatagatgcctcttaggactggtgcctggcacagccgcgggccaggaggctgccacacggaagcaagcagatgaactaatttcatttcaaggcagtttttaaagaagtcttggaaacagacggcggcacctttcctctaatccagcaaagtgattccctgcacaccagagacaagcagagtaacaggatcagtgggtctaagtgtccgagacttaacgaaaatagtatttcagctgcaataaagattgagtttgcaa

SEQ ID NO: 406 - DNA, 1209 bp, Homo sapiens
cgaagcgaggagcagcgatggacggtcgggtgcagctgataaaggccctcctggccttgccgatccggcctgcgacgcgtcgctggaggaacccgattccctttcccgagacgtttgacggcgataccgaccgactcccggagttcatcgtgcagacgggctcctacatgttcgtggacgagaacacgttctccagcgacgccctgaaggtgacgttcctcatcacccgcctcacagggcccgccctgcagtgggtgatcccctacatcaagaaggagagccccctcctcaatgattaccggggctttctggccgagatgaagcgagtctttggatgggaggaggacgaggacttctaggccgggagaccctcgggcctgggggcgggtgctctggggagggtccgctgtgttactggccgccgccagggtcgccaccggcgccctccctccgcgcctccctccccctcgagccgccgcgatgtcccctgcgctcctgttccctcccgcgtagtgcttgcctttgttccaggaatagcgctccaggctcctgctgccgcccctgggcctcactctggagcgagccgccgccctctccttccagccagccagcccctcccatgtacatttggacgctgtcctgcgctccagctgcaagctgggctcctgttacacactggacagaccacccactgccgccgctgccaagccctctcctccccaccagactgccagacgactacatcattctgcccacagacctgcgctgccacagccatcgccatccatcgcatcccaccgacagactgctgctcctagtgatctggactcacctcggaggtatctgggctggccacagtccctggacagtgatccagacagctggccgccccccaagggatctgtcaccttcagcgagacctatttcctccccacccccagaaacctcttgtgttcttgcctaggcccaggtgttcctggcagccaaatcgagtctctcattttctcttgtggaccagttagttttgcccataacgcagtattctgagtttgcaactgtctctctgatgtgtgccttttgttcaacacagtaacccctgcattctgctctgctctaatacactacctggagaaagtcttttccttattttcaataaatgtcagacattattgaaaagaaaaaaaaaaaaaaaaaaaaaaaaaaaaaaaa

SEQ ID NO: 407 - DNA, 1750 bp, Homo sapiens
gtggccgccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacc

SEQ ID NO: 408 - DNA, 1652 bp, Homo sapiens
tcccgacgagcaacgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagctcctcagcccccaggattgacctctggggagtgatggtagcgttggtgccaggccgtgggttcaggtgtggcagaagcttgcagatgcgtccgaagggaaataaagtgtgttggcgttag

SEQ ID NO: 409 - DNA, 1399 bp, Homo sapiens
ttgccggcgcaagagccaagccgccagcgctgctatgtgggccacgctgccgctgctctgcgccggggcctggctcctgggagtccccgtctgcggtgccgccgaactgtccgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcaatcgccatcgcaaccggaaagatgctgtccttggcggaacagcagctggtggactgcgcccaggacttcaataattacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctcca

SEQ ID NO: 410 - DNA, 5356 bp, Homo sapiens
cgggattcggctggctctgccacaccaccgcgcgcccccgctccgcccgcccctccgggcgcgtcttttccgggctcgcgctgagtcccgcctccgccggctgtccgggtgcgcgcgcgccgctgcggctttttctctggcctccgccgcgcgctcctcctcgtcccagcgctagcgggcacgcggttcctttttgcgagctttccgagtgccaggcgccggccggctgcgaagacgcggtgggccgcccctccgattgaaatcacagaagatattcgtgttcttcttaagagaaaaagaggacattttagctttctcagttgaaggcgtactttattgtcggcttccaaagattactaacttttatctgtatcactaagattgaactgccttggctgtactgctattcttactgctgcttctattattgccttcttcagcacaataaggctttcaaaagccaaagaataacaagaaataagcaccattttagaagcctttccactatgaaacttaagctaaatgtgctcaccattattttgctgcctgtccacttgttaataacaatatacagtgcccttatatttattccatggtattttcttaccaatgccaagaagaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatgaactatcttgaagtgaatcgcagagtgaataactttggtagtggactcactgcactgggactaaaaccaaagaacaccattgccatcttctgtgagaccagggccgaatggatgattgcagcacagacctgctttaagtacaactttcctcttgtgactttatatgccacacttggcaaagaagcagtagttcatgggctaaatgaatctgaggcttcctatctgattaccagtgttgaacttctggaaagtaaacttaagactgcattgttagatatcagttgtgttaaacatatcatttatgtggacaataaggctatcaataaagcagagtaccctgaaggatttgagattcacagcatgcaatcagtagaagagttgggatctaacccagaaaacttgggcattcctccaagtagaccaacgccttcagacatggccattgttatgtatactagtggttctactggccgacctaagggagtgatgatgcatcatagcaatttgatagctggaatgacaggccagtgtgaaagaatacctggactgggaccgaaggacacatatattggctacttgcctttggctcatgtgctagaactgacagcagagatatcttgctttacctatggctgcaggattggatattcttctccgcttacactctctgaccagtccagcaaaattaaaaaaggaagcaaaggagactgtactgtactgaagcccacacttatggctgctgttccggaaatcatggatagaatttataagaatgttatgagcaaagtccaagagatgaattatattcagaaaactctgttcaagatagggtatgattacaaattggaacagatcaaaaagggatatgatgcacctctttgcaatctgttactgtttaaaaaggtcaaggccctgctgggagggaatgtccgcatgatgctgtctggaggggccccgctatctcctcagacacaccgattcatgaatgtctgcttctgctgcccaattggccagggttatggactgacagaatcatgtggtgctgggacagttactgaagtaactgactatactactggcagagttggagcacctcttatttgctgtgaaattaagctaaaagactggcaagaaggcggttatacaattaatgacaagccaaaccccagaggtgaaatcgtaattggtggacagaacatctccatgggatattttaaaaatgaagagaaaacagcagaagattattctgtggatgaaaatggacaaaggtggttttgcactggtgatattggagaattccatcccgatggatgtttacagattatagatcgtaagaaagatctagtgaagttacaagcaggagagtatgtatctcttgggaaagtagaagctgcactgaagaattgtccacttattgacaacatctgtgcttttgccaaaagtgatcagtcctatgtgatcagttttgtggttcctaaccagaaaaggttgacacttttggcacaacagaaaggggtagaaggaacttgggttgatatctgcaataatcctgctatggaagctgaaatactgaaagaaattcgagaagctgcaaatgccatgaaattggagcgatttgaaattccaatcaaggttcgattaagcccagagccatggacccctgaaactggtttggtaactgatgctttcaaactgaaaaggaaggagctgaggaaccattacctcaaagacattgaacgaatgtatgggggcaaataaaatgttgttgtcttattgacagttgtgcaggaggtagcctggtggttttcaacctctagaattttaagcctttgttgaactgttagaatgtaaggtatatcattctaaagatagagtaaaaagaaaacaaaaccaaaagttattaaaattgttgtccggtttactttaacttagttttgcatagttctagtgcagctgaaattgaaaagttatttccctttagctgtgttattatagagcagaaattctgtttttaaaaattagcctaagatatacttgtttttgtaaagaaaaatatttaatgttgaacaaaataaattggagttggagtagaatgtagtttgaggaaatttgcagcttccaatgcctcttgtcttcctatttcagaagtttaaatattaagcatgacagaaaatatgtattaacactactcaaagcaaaagtgctgcagggctttaaaattctcttccaaccatttatcttgaaggaaaaattcaatagtaatataatacacaaaatcaaataataccttagaaggtattaagattataattgttgcataggttagatatagagtcattgtaatgttgtgaataattacagtgcctaaaataagaatagaacaacatatacaacaccaaaaaatatctagtaatatatttaaagggaaattgagctgctttttttgaaactttgagatctaaaaataactgtaattatttgaatgactaagaggaaagtacattttttgaaatgctgaaaattgcctttctgtgtttattcaaactgaaaagctgagaccaagagcaaggaaggtaaaaagttaacaggcaaacattttctcttagaaaaggtgataaaatcataagtatttggaattagaacccttgcacagcactgaacctgggaaagagatttaaactctgaatttatctttgataacagggattgattttaaaatgtacatgtattaaattacatttgtaatttaaggtctgtttgctgttgctgattttattcttgatcagtagtttgcatttcagaaagcctttcattttgctttaagtttagcaaagcggggttataatgaatgacttccccaatatcttgcttgaacttacagtgattaacttggatgagttttgggaagttaaagggaagaaaacactgttatcattttttcctgtttgggaagagcttagaaactggaaatactagatttgggagaagggcagagttacttgataagggacttgatgtttgtgcagtaacttgggagtgtggtttctttttgaatctttaattaaaacctgggattatatatccctgataaatattcacacttgaaccatagttactgtaaaatgcaaaaaatcttaatactgttattctttgcactttttcttaatcattttttatatatatgcatatatatatgtgtgtgtgtgtgttgcttatgttgttttgtacagatgtgggccaccattgcaacaaaatacattctttttgctctaaaatatttatgaagaaaatacttaaatgttatgtatatggtggtaataagggaaaaatcaagtattataaacaagaatgaaggtttttgtaaagatttctgttcagcgttttgcaaggtaaaattttaggcaagttttccctgaagttatgtgtatgtgagtattctcattcttcccaacttgcctttgaagagtgaaataccattattatcaagtagactactgttcagcttttattccttccctggttgtttatcccttaggaatgagtttcttagactttcccaatatgtgattttttttcccatttagaatggtgattttaaatgtgtgagtgcatgtactatcttatctcagatatttgcacccccaatctgcccccaactcccaaaagctagaacactgccaactgatctgttataggtcctttagaaacacataattaacacttaaggttgggtgctgctaattctttgcaaaaatccaaatattgttaagggaccagggagatgccactaccccttgattttccatctaaaaatatacatgtttatgtaaacaaatctttccatatccatagtgacttttcaagtatttaagcctaaagattttgatctcacatttttatacctgtttaaattgctcacagttattacatacacatcagccatcaactaaagttgtactttaaaaatttactacaatatgtacatttctaagtcaaacacttgtgacttttgctttaattccatgaatgttcctgcctccttgatatttgtatttattctttttttctctagagtagaggtataattgtgtgatatttcagaaatacagataaatgattcaaaaagtcacagttaaggagaatcatgtttctttgatcatgaataactgattagtaagtcttgcctatattttcctgatagcatatgacaaatgtttctaaggtaacaagatgagaacagataaagattgtgtggtgttttggatttggagagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatcaaaaaaaaaaaaaaaaaaaa

SEQ ID NO: 411 - DNA, 3900 bp, Homo sapiens
cgatggccctgcccagtcccagacagaacctactacgtgcggcggcagctggggcgggaaggcgggcgctgggggcgctgcggccgctgcagcgcagggtccacctggtcggctgcacctgtggaggaggaggtggatttcaggcttcccgtagactggaagaatcggctcaaaaccgcttgcctcgcaggggctgagctggaggcagcgaggccgcccgacgcaggcttccggcgagacatggcagggcaaggatggcagcccggcggcagggcccggcgaggagcgcgaacccgcggccgcagttcccaggcgtctgcgggcgcgagcacgccgcgaccctgcgtgcgccggggcgggggggcggggcctcgcctgcacaaatagggacgagggggcggggcggccacaatttcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaacttgtttttattccccactactcttctctctatcagataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaactgagcagtttcactagtggaaataccaaaagcttcctacgtgtatatccagaggtttgtagataaatgttgccaccttgtttgtaacagtgaaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaagttcttttttttttagacagcgtttcgctcttgttgcccaggctagcatgcaatggtgtgacctcggcttactgcaacctccgccttcccagattcaagcgattctcctgcctcaggctcccaagtagctaggaccaggtgcgcgccaccacgcccggctaatttttgtattttgtatttttagtagagatggggtttcaccatgttggtcaggctagtctcgaactcgtgaccgcaagcgattcacccacctcagcctcccaaagtgctgggattaccggcttgagccaccacacccggcacatcttcattctttttatgtagtaaaaagtataaggccacacatggtttatttgaagtattttataatttaaaaaaatacagaagcaggaaaaccaattataagttcaagtgagggatgatggttgcttgaaccaaagggttgcatgtagtaagaaattgtgatttaagatatattttaaagttataagtagcaggatattctgatggagtttgactttggttttgggcccagggagtttcagatgcctttgagaaatgaatgaagtagagagaaaataaaagaaaaaccagccaggcacagtggctcacacctgtaatcccagcgctttgggaggctaaggcaggcagatcacttgagaccagcttgggcaacatggcaaagccccatctctacaaaaaacacaaaaattagctgggcattgtggcgcacacctgtattcccatctagtcaggaagctgagatggaagaattaattgagcccacgagttcaaggctgcagtgagtcgtgattgtgccactgcactccagccggggtgacagaagagaccttgtctcgaaaacgaatctgaaaacaatggaaccatgccttcataattctagaaagttattttcaactgataaatctatattcacccaaataatcaagggtgaaggtaaaataatacatttttagacaagcaaagactcaggggttacctccatgtgccctttttagggaagctgttggagaaaatactccagcaaaatgaaggagtacacaaaccagagaatgacatgaatccagcaaataggatccaacacaggcaatattccagctatggagctagctttaaaaaggaacagtaaaaatattaatcggttagctgggtggaatggcccatgcctgtagtcccagctactcaggaggctcagcagcaggacgacttgagcccaagagttccagaccagcctggccaccttagtgagatcccttctcttaaaaataataacttattgccagatttggggcatttggaaagaagttcattgaagataaagcaaaagtaaaaaaaaaaaaaaaaaaaacaaggggaaagggttggttaggcaatcattctagggcagaaagaagtacaggataggaagagcataatacactgtttttctcaacaaggagcagtatgtacacagtcataatgatgtgactgcttagcccctaaatatggtaactactctgggacaatatgggaggaaaagtgaagattgtgatggtgtaagagctaatcctcatctgtcatatccagaaatcactatataatatataataatgaaatgactaagttatgtgaggaaaaaaacagaagacattgctaaaagagttaaaagtcattgctctggagaattaggagggatggggcaggggactgttaggatgcattataaactgaaaagcctttttaaaattttatgtattaatatatgcattcacttgaaaaactaaaaaaaaacaataatttggaaaaacccatgaaggtaactaacggaaggaaaaactaagagaatgaaaagtatttgcctctggaaagaacaactggcaggactgttgttttcattgtaagacttttggagccatttaattgtacttaaccattttcatctatttctttaataagaacaattccatcttaataaagagttacacttgttaata

SEQ ID NO: 412 - DNA, 2914 bp, Homo sapiens
  modified_base (28)..(29): a, c, g, or t
  modified_base (771)..(771): a, c, g, or t
  modified_base (2072)..(2072): a, c, g, or t
  modified_base (2200)..(2200): a, c, g, or t
  modified_base (2708)..(2709): a, c, g, or t
  modified_base (2712)..(2712): a, c, g, or t
  modified_base (2714)..(2715): a, c, g, or t
  modified_base (2727)..(2736): a, c, g, or t
  modified_base (2874)..(2874): a, c, g, or t
gctgcggcccgaggacgcgacgcgagcnnagttccggcgaggaggccgcgccagtgacagcgatggcggcggagtcggcgctccaagttgtggagaagctgcaggcgcgcctggccgcgaacccggaccctaagaagctattgaaatatttgaagaaactctccaccctgcctattacagtagacattcttgcggagactggggttgggaaaacagtaaatagcttgcgaaaacacgagcatgttggaagctttgccagggacctagtggcccagtggaagaagctggttcctgtggaacgaaatgctgagcctgatgaacaggactttgagaagagcaattcccgaaagcgccctcgggatgccctgcagaaggaggaggagatggagggggactaccaagaaacctggaaagccacggggagccgatcctatagccctgaccacaggcagaagaaacataggaaactctcggagctcgagagacctcacaaagtgtctcacggtcatgagaggagagatgagagaaagaggtgtcacagaatgtcaccaacttactcttcagaccctgagtcttctgattatggccatgttcaatcccctccatcttgtaccagtcctcatcagatgtacgtcgaccactacagatccctggaggaggaccaggagcccattgtttcacaccagaagcctgggaaaggccacagcaatgcctttcaggacagactcggggccagccaagaacgacacctgggtgaaccccatgggaaanggggttgtgagtcaaaacaaggagcacaaatcttcccacaaggacaaacgccccgtggatgccaagagtgatgagaaggcctctgtggtgagcagagagaaatcacacaaggccctctccaaagaggagaaccgaaggccaccctcaggggacaatgcaagggagaaaccgccctctagtggcgtaaagaaagagaaggacagagagggcagcagcctgaagaagaagtgtttgcctccctcagaggccgcttcagacaaccacctgaaaaagccaaagcacagagacccagagaaagccaaattggacaaaagcaagcaaggtctggacagctttgacacaggaaaaggagcaggagacctgttgcccaaggtaaaagagaagggttctaacaacctaaagactccagaagggaaagtcaaaactaatttggatagaaagtcactgggctccctccctaaagttgaggagacagatatggaggatgaattcgagcagccaaccatgtcttttgaatcctacctcagctatgaccagccccggaagaaaaagaaaaagattgtgaaaacttcagccacggcacttggagataaaggacttaaaaaaaatgactctaaaagcactggtaaaaacttggactcagttcagaaattacccaaggtgaacaaaaccaagtcagagaagccggctggagctgatttagccaagctgagaaaggtgcctgatgtgttgccagtgttgccagacctcccgttacccgcgatacaggccaattaccgtccactgccttccctcgagctgatatcctccttccagccaaagcgaaaagcgttctcttcaccccaggaagaagaagaagctggatttactgggcgcagaatgaattccaagatgcaggtgtattctggttccaagtgtgcctatctccctaaaatgatgaccttgcaccagcaatgcatccgagtacttaaaaacaacatcgattcaatctttgaagtgggaggagtcccatactctgttcttgaacccgttttggagaggtgtacacctgatcagctgtatcgcatagaggaatacaatcatgtattaattgaagaaacagatcaattatggaaagttcattgtcaccgagactttaaggaagaaagacccgaagagtatgagtcgtggcgagagatgtacctgcggcttcaggacgcccgagagcagcggctacgagtactaacaaagaatatccagttcgcacatgccaataagcccaaaggccgacaagcaaagatggcctttgtcaactctgtggnccaagccacctcgtgacgtccggaggaggcaggaaaagtttggaacgggaggagcagctgtccctgagaaaatcaagatcaagccagccccgtaccccatgggaagcagccatgcttccgccagtagnatcagctttaaccccagccctgaggagccggcctatgatggcccaagcaccagcagtgcccacttggcaccagtggtcagcagcactgtttcctatgatcctaggaaacccactgtgaagaaaattgccccaatgatggccaagacaattaaagctttcaagaacagattctcccgacgataaactgaggacttgccttggaaatggaatctggggaggcaggaatacaaggacagtgggggttggggaatggaattctacaggagactggagtcttgctttgtggatccttttggtctccgagtcctgcagtctgcaggtgctgcccctgggaacctgcgtgccacagccccgcctccctgcctggagcacactttagaattctgaagatgtgaagcctctgtctcactgaggattttaaaggtcaattatacttttgttgttcattagcatctttgtaaactataagacgtagttttaattaataaatattgcccccagattgtanntanannaaaaaaaaaaannnnnnnnnntttttgtcctctaccacacatttagccttttatcttccaggtccttattaaaatcagatgaaagcctagtgaaagccagtcttctgccccagctcagctctgtgtggactctggtccagacagaggactgggcatctncagacctgcacagtacctgctgacgtagggcaaggaatga

SEQ ID NO: 413 - DNA, 1276 bp, Homo sapiens
ctccctggttccgcgttctggttccgccatggaatccaacaaggatgaagctgagcgctgtatcagcatcgccctcaaggccatccagagcaaccagcccgaccgggcgctccgcttcctggagaaggcacagcggctgtatccgacgccgcgagttcgcgccctgattgagtccctcaaccagaaaccacagactgccggtgaccaacccccacccacagacacaacccatgcctcccacaggaaagcaggtgggaccgatgccccctcggccaacggtgaagctggaggagagagcaccaaaggctacactgcagaacaggttgcagctgtgaaaagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggctccccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagaggtgcaggcctccctgcatggatagtcctgggccagccacaccaccgaggtccaaactatgaaatccctggagaatttttggtgacatgcactgagccaaggtgatggactgtatatttgaggaaagacaaacaaagaaacaaaa

SEQ ID NO: 414 - DNA, 5875 bp, Homo sapiens
  modified_base (988)..(988): a, c, g, or t
  modified_base (990)..(991): a, c, g, or t
  modified_base (995)..(995): a, c, g, or t
  modified_base (997)..(1000): a, c, g, or t
  modified_base (1003)..(1011): a, c, g, or t
  modified_base (1066)..(1066): a, c, g, or t
  modified_base (1321)..(1321): a, c, g, or t
  modified_base (1335)..(1335): a, c, g, or t
  modified_base (3534)..(3534): a, c, g, or t
  modified_base (3990)..(3990): a, c, g, or t
  modified_base (4407)..(4407): a, c, g, or t
  modified_base (4674)..(4674): a, c, g, or t
  modified_base (4790)..(4790): a, c, g, or t
  modified_base (4858)..(4858): a, c, g, or t
  modified_base (4975)..(4975): a, c, g, or t
  modified_base (5250)..(5250): a, c, g, or t
  modified_base (5253)..(5253): a, c, g, or t
  modified_base (5255)..(5257): a, c, g, or t
  modified_base (5259)..(5259): a, c, g, or t
  modified_base (5262)..(5262): a, c, g, or t
  modified_base (5689)..(5689): a, c, g, or t
ggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacatctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgatcgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgngnnaagncnnnntcnnnnnnnnntaccaatttgagaaagaaggagatttccaagattctgagaagttcctgcctcagngggatgaatttggcttcgtttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctngccgtcagatggtnaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatatgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttgtcatcttctctccaggggctctggaccatccgggcatacaaagcagaagagaggtgtcaggaactgtttgatgcacaccaggatttacattcagaggcttggttcttgtttttgacaacgtcccgctggttcgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaaaatgtcaatcatacctcaggaacctgttttgttcactggaacaatgaggaaaaacctggatccctttaangagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtnatacttcaaaagaaattatccacatattggtcacactgaccacatggttacaaacacttccaatggacagccctcgaccttaactattttcgagacagcactgtgaatccaaccaaaatgtcaagtccgttccgaaggcattttccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacanagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaantggatacatggttaaaggatagaagggcaatattttatcatatgttctaaaagagaaggaagagaaaatactactttctcaaaatggaagcccttaaaggtgctttgatactgaangacacaaatgtgaccgtccatcctcctttagagttgcatgacttggacacggtaactgttgcagtttnagactcagcattgtgacacttcccaagaaggccaaacctctaaccgacattcctgaaatacgtggcattattcttttttggatttctcatttatggaaggctaaccctctgttgacngtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctntantnnntnctngatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcaacagtgatcataatgaggtttgttaaaangatagctatattcaaaatgtctatatgtttatttggacttttgaggttaaagacagtcatataaacgtcctgtttctgttttaatgttatcatagaattttttaatgaaactaaattcaattgaaataaatgatagttttcatctccaaaaaaaaaaaaaaaaaaaaaaaaaaaaaaaaaaaaaaa

SEQ ID NO: 415 - DNA, 1562 bp, Homo sapiens
ctggaattcggggcgccgagcaggagcagggaacaaaggagcggagaggggaggggagagagttgggcgagggagagcccccggccggctgccagaagatcctggcgggaggaagcccaagtgtcacttgaattccacccaaggagcgggcgcctgggatcagagcgtcctgtttagcaataacggctggagcacgtcctacaagttacgggagagtcggctgtgaaggagacgttcgcttatcccctgtgtccccgctcctggcccctccagacccccgccttgcctcgcgctgggaggggagatccagaatgaaaggcaagaaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgatttttttttttcctccccttccctttttttgttattttttcagactgtgcaatacttagagaacctatagcatcttctcattcccatgtggaacaggatgcccacatactgtctaattaataaattttccattttttttcaaacaagtaaaaaaaaaaaaaaaaaaaa

SEQ ID NO: 416 - DNA, 2648 bp, Homo sapiens
gtgacagaagctgtgggaggagctggaggcttcaccgtggtaatcacagcgccgctgctgccccgccttgcaggtctcaggactgtcatcgcctctgggtgtgagggtactttggccaccgtccccggaaataaccgcgcctgcctctcaagataccccatcctctccacgccgctgccgctgccgccatgcaaggggaggacgccagatacctcaaaaggaaagttaaaggagggaatatagatgtacatccatcagaaaaagcactcattgttcactatgaagtggaagctaccattcttggagaaatgggggaccccatgttgggagaacgaaaagaatgtcaaaaaatcattcgacttaagagtctcaatgccaacacagatataacttccctggcaaggaaggtggttgaagaatgtaaactcattcatccttcaaaactaaatgaggtagaactgctgttgtactatctacagaaccgccgtgattcattgtcaggaaaagagaaaaaagaaaaatcaagcaagcctaaagatccacctccttttgaaggaatggagattgatgaagttgctaacattaatgacatggatgaatatattgagttattatatgaagatattcctgacaaagttcggggttctgctttgatcctgcagcttgctcgaaatcctgataacttggaagaactactattgaatgaaactgcccttggtgcattagcaagggtcctgagagaagactggaagcaaagtgtcgagttagctacaaacataatttacatctttttttgtttctccagcttttctcaatttcatggacttattactcactataaaattggagctctgtgtatgaatattattgatcatgagttaaaaagacatgagctttggcaagaagaactctcaaagaagaagaaagctgttgatgaagaccctgaaaaccaaaccttgagaaaggattatgaaaaaacctttaaaaagtaccaggggcttgtggtaaaacaggaacagctattacgagttgctctttatttgcttctgaatcttgctgaggatactcgtaccgaactgaaaatgaggaacaagaacatagttcacatgttggtgaaagcccttgatcgggacaattttgagctgctaattttagttgtgtcattcttgaagaaactcagcatttttatggagaataaaaatgatatggtggaaatggatattgttgaaaaactggtgaaaatgataccttgtgagcatgaagacctgctgaatatcaccctccgacttttactaaacctatcctttgacacaggactgaggaataagatggtacaagttggactgcttcccaagctcactgcactcctaggcaatgacaactacaaacaaatagcaatgtgtgttctttaccacataagcatggatgaccgctttaaatcaatgtttgcatacactgactgtataccacagttaatgaagatgctgtttgaatgttcagatgaacgaattgacttggaactcatttctttctgcattaatcttgctgctaacaaaagaaatgtacagcttatctgtgaaggaaatgggctgaagatgctcatgaagagggctctgaagtttaaggatccattgctgatgaaaatgattagaaacatttctcagcatgatggaccaactaaaaatctgtttattgattatgttggggaccttgcagcccagatctctaatgatgaagaagaggagttcgtgattgaatgtttgggaactcttgcaaacttgaccattccagacttagactgggaattggttcttaaagaatataagttggttccatacctcaaggataaactaaaaccaggtgctgcagaagatgatcttgttttagaagtggttataatgattggaactgtatccatggatgactcttgtgctgcattgctagccaaatctggcataatccctgcactcattgaattgctaaatgctcaacaagaagatgatgaatttgtgtgtcagataatttatgtcttctaccagatggttttccaccaagccacaagagacgtcataatcaaggaaacacaggctccagcatatctcatagacctaatgcatgataagaataatgaaatccgaaaggtctgtgataatacattagatattatagcggaatatgatgaagaatgggctaagaaaattcagagtgaaaagtttcgctggcataactctcagtggctggagatggtagagagtcgtcagatggatgagagtgagcagtacttgtatggtgatgatcgaattgagccatacattcatgaaggagatattctcgaaagacctgaccttttctacaactcagatggattaattgcctctgaaggagccataagtcccgatttcttcaatgattaccaccttcaaaatggagatgttgttgggcagcattcatttcctggcagccttggaatggatggctttggccaaccagttggcattcttggacgccctgccacagcatatggattccgccctgatgaaccttactactatggctatggatcttgataaagtatctgtttccatgtgtaatctcagcttagaagaaatctgtgtgggttgggttaattttggatctttgcctaataa

SEQ ID NO: 417 - DNA, 704 bp, Homo sapiens
gggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaa

SEQ ID NO: 418 - DNA, 1280 bp, Homo sapiens
tgccgcagcccccgcccgcccgcagagcttttgaaaggcggcgggaggcggcgagcgccatggccagtccgggctgcctgctgtgcgtgctgggcctgctactctgcggggcggcgagcctcgagctgtctagaccccacggcgacaccgccaagaagcccatcatcggaatattaatgcaaaaatgccgtaataaagtcatgaaaaactatggaagatactatattgctgcgtcctatgtaaagtacttggagtctgcaggtgcgagagttgtaccagtaaggctggatcttacagagaaagactatgaaatacttttcaaatctattaatggaatccttttccctggaggaagtgttgacctcagacgctcagattatgctaaagtggccaaaatattttataacttgtccatacagagttttgatgatggagactattttcctgtgtggggcacatgccttggatttgaagagctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaagaattttacaatgaatgaaaagttaaagaagtttttcaatgtcttaactacaaatacagatggcaagattgagtttatttcaacaatggaaggatataagtatccagtatatggtgtccagtggcatccagagaaagcaccttatgagtggaagaatttggatggcatttcccatgcacctaatgctgtgaaaaccgcattttatttagcagagttttttgttaatgaagctcggaaaaacaaccatcattttaaatctgaatctgaagaggagaaagcattgatttatcagttcagtccaatttatactggaaatatttcttcatttcagcaatgttacatatttgattgaaagtcttcaatttgttaacagagcaaatttgaataattccatgattaaactgttagaataacttgctactcatggcaagattaggaagtcacagattcttttctataatgtgcctggctctgattcttcattatgtatgtgactatttatataacattagataattaaatagtgagacataaatagagtgctttttcatggaaaagccttcttatatctgaagattgaaaaataaatttactgaaatacaaaaaaaaaaaaaaa

SEQ ID NO: 419 - DNA, 577 bp, Homo sapiens
cgcgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaattctggaataaatttttggagaataaatccccttggaggaaaatggtccatggggtatacaaaaagagtatctttgttttcactcatgtacttgtacctgtctggattattcattattacatgaagtatcatgtttctgaaaaaccatatggcatagttgaaaagaagtccagaatattccctggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcagaaattgtcaaaaaaaaaa

SEQ ID NO: 420 - DNA, 897 bp, Homo sapiens
agagactgcgagaaggaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtggg

SEQ ID NO: 421 - DNA, 4617 bp, Homo sapiens
atccgataggaccaggtagccactgagcatgcctgtctggtgggcatagcctctgtgcctggtggggtccagccctgtatgtggacttcctgggggaccgcctgcatgctgggaaagtcctgcaactgtgggctctgggccggacccctcctccttggggagcgttgctgtggtctccgcagcctgttggtgtggtccgagaggggactggtgtgtggtggtagggacgcaggtgctcaggagggctcctcaggctgcctctctgcctgttactgctgctccctccctggtcctggggactcgctcaggcctggatgtgtggttttggacaccttggaaagaggttagctgtgagttttgctttgattgggctttgagctgctgagctagatctgtccaagcatgcttttgtggttttctcgagtctttggtcaccctgcgtagaattacctttacttttgccttcattttaggtaatcattaccaaatgaggaggaaaggacgatgtcatcgaggctctgcagcgaggcatccttcttccccatgcagtgttaaacactcccctacgcgagaaacgctgacctacgctcaagctcaaaggatggtagagatagaaattgaagggcgcttgcacaggatcagtatttttgatcccctggagatcatattggaagatgacctcactgctcaagagatgagtgagtgcaacagcaacaaggaaaacagcgagcggcctcctgtctgcttaagaactaagcgtcacaaaaacaacagagtcaaaaagaaaaacgaggccctccccagcgcccacggcacgccggcctcggccagtgccctcccggagcccaaggtgcgcatcgtggagtacagccctccgtccgcccccaggaggcctcctgtgtactacaagttcatcgagaagtcggccgaggaactggacaacgaggtggagtatgacatggacgaggaggactatgcctggctggagatcgtcaatgagaagcgcaagggcgactgcgtccccgccgtgtcgcagagcatgtttgagttcctgatggaccgcttcgagaaggagtcgcactgcgagaaccagaagcagggcgagcagcagtctctgatcgacgaggacgccgtgtgctgcatctgcatggacggggagtgtcagaacagcaacgtgatcctcttctgcgacatgtgcaacctggccgtgcaccaggagtgctacggggtgccctacatccccgagggccagtggctctgccgccactgcctgcagtcgcgggcccggcccgccgactgtgtgctgtgccccaacaagggtggtgccttcaaaaagacagatgacgaccgctggggtcacgtggtgtgtgccctgtggatcccagaggtcggctttgccaacacggtgttcatcgagcccatcgatggggtgaggaacatccctccagcccggtggaaactgacatgctacctctgtaagcagaagggcgtgggtgcctgcatccagtgccacaaagcaaactgctacacagcattccatgtgacgtgtgcccagaaggctggcctgtacatgaaaatggagcccgtgaaggaactgactggcggtggcaccaccttctccgtcagaaagaccgcttactgtgatgtccacacgcctccaggctgcacccggaggcctctgaatatttacggggatgtcgaaatgaaaaatggcgtctgtcgaaaagagagctcggttaaaacggtcaggtccacatccaaggtcaggaagaaggcaaaaaaggctaagaaagctctggctgagccctgcgcggtcctgccgaccgtgtgcgctccttatattcccccgcagaggttaaataggattgcgaatcaggtggccattcagcggaagaagcagtttgtggagcgagcccacagctactggctgctcaagcggctgtccaggaacggggcccccctgctgcggcggctgcagtccagcctgcagtctcagcgaagctcacagcagagagaaaatgatgaggagatgaaggctgccaaagagaagctgaagtactggcagcggctgcggcacgacctggagcgcgctcgcctgctgatcgagctgctgcgcaagcgggagaagctcaagcgtgagcaggtgaaggtggagcaggtcgccatggagctgcggctgaccccgctgacggtgctgctgcgctcagtgctggaccagctgcaagacaaggaccccgccaggatatttgcgcagcccgtgagtctgaaggaggtaccagattatttggatcacattaaacatcccatggactttgccacaatgaggaaacggttagaagctcaagggtataaaaacctccatgagtttgaggaggattttgatctcattatagataactgcatgaagtacaatgccagggacaccgtgttctatagagccgcggtgaggctgcgcgatcagggaggtgttgttctgaggcaggcccggcgcgaggtggacagcatcggcttggaagaggcctcggggatgcacctgcctgagcggcctgctgcggcaccgcggcggcctttctcctgggaagacgtggacaggttgctggaccccgccaacagagcccacctgggcctggaggagcagctgagagagctgctggacatgctcgacctcacctgcgctatgaagtccagcggctcccggagcaagcgggcaaagctgctcaaaaaggaaattgcccttctccgaaacaagctgagccagcagcacagccagcccctgcccacggggccaggcttggaaggcttcgaagaggacggagctgcgctggggccggaggcgggcgaggaagtccttccgaggttggagactcttctgcagccaaggaaaaggtcgcggagcacatgcggagactccgaggtggaggaggagtccccaggaaagcgcctggacgcaggtctcaccaacggctttgggggtgcgaggagcgagcaggagccgggcggcggcctggggaggaaggccacaccccgacgacgctgtgcctccgagtccagcatctcctccagcaacagcccgctctgcgactcgagctttaatgcgcccaaatgtgggcggggcaaaccggctcttgtgcgacggcacacgctggaggaccgcagtgagctgatctcctgcatcgagaatgggaactacgccaaggcggccaggatcgcagccgaagtcggccagagcagcatgtggatctccactgatgccgccgcctcggtgctggagcctctgaaggtggtgtgggccaagtgcagcggctacccctcctacccggcactgatcatcgaccccaagatgccccgtgtgcctggccaccacaacggcgtcaccatcccggccccacccctggacgtgctgaagattggggagcacatgcagaccaagtctgatgagaagctgttcctcgttctcttttttgataataagagaagttggcagtggcttcctaagtccaaaatggttccccttggtattgacgaaactatagacaagttaaagatgatggaagggaggaattccagcatccggaaggccgtgcggatcgcttttgaccgcgccatgaaccacctgagccgcgtccacggggagccgaccagcgacctcagtgacattgactgacggcccggccgccagcgcgggtcttgtccatagtgttgataagctgtacatgtttgtatattgttcaaaacttaacttattctgatttttagttatagctctttaattctttttccccggggaggggggaggttttatttccaagttttctaggaacccatctccgtctgggcgctgtgagtggggtgggcacgtccgggcagcccagtgcgtctgtcgcacgtccccaggccgtgctgctggcgtcactttctttgatatgtagctttttcttaaagacttttgaatgtttaataattttgtaaatcatgctctttacacagagtaccacttatttaataagacgggatgtaaatttacaatgacaaatgtgtattttaagaaagaaaatgacattattttgaatggtactttgtggaaagaggggagaataaagttatgctgtgtacatcacttgcagatcaccaaaaacactccgctgcccgtgaccgccggtgggtgtgtccccgctcccgtcgtcccgcccacctcaaaccccgcaggtgtgcctcccagcggattatttattgtagaaagtgtattcatttgctttataatgaaaaatacatttgcaaaggtatattgatatgcatttttatacaggcacataaaaattcaacttggcttgggagcagaatgcattgcattgtataaatgactctggcctgtgtgtactttgattttataacttgtaatcttttgtttacaatgaggggctttctgtaacttgttttaatttagaacactttggtagcaatagaaactttggatacatttttgtatggtacctgtgatgtatatagaattagtactttatttttatttttaagaggtaaagcattatgttggggaaagtagggtgggtttccaaatttgcattttttatattaaaaataaagtcaagaaaaaaaaaa

SEQ ID NO: 422 - DNA, 2707 bp, Homo sapiens; identical to SEQ ID NO: 334

SEQ ID NO: 423 - DNA, 3003 bp, Homo sapiens; identical to SEQ ID NO: 148

SEQ ID NO: 424 - DNA, 2215 bp, Homo sapiens
actcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgccggcctcggcgcaggccagcgggaagaccttgccaatcccggtccagatcacactccgcttcaacctgcccaaggagcgggaggccattcccggtggcgagcctgaccagccgctctcctccagctcctgcctgcagcccaaccaccgctcaacgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctaccggaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctgcagggcccacttgcccagcaccaaggcgagctccgggctcagaccaactccaaggtcagctggccacagcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccaaaaaaaaaaaaaaa

SEQ ID NO: 425 - DNA, 1977 bp, Homo sapiens
caaattattattgtctcttaggtttggatattgatgggatatacagagtaagtggcaacctcgcagtgatccagaaactaaggtttgcagtcaatcatggtaagattatatttactgttgttattcagatgcatcactcataactttttgaactggcttaaagtaattttttaaaatgtccaattcctgctgtttttcagatgagaaattggacttgaatgacagtaaatgggaagatattcatgtcattactggagccctcaaaatgttttttcgagaattaccagaacctctttttacatttaatcattttaatgattttgttaatgcaattaagcaagaaccaagacagcgagtcgctgctgttaaggacctaatcagacagttgccaaagccaaaccaagacacaatgcagattcttttccgacatctcagaagagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactctaagaggtttagagatttttccattgg

SEQ ID NO: 426 - DNA, 1488 bp, Homo sapiens
gccacgtcactggctcaggctcagctgctgggtcaccaggagaatggacccttcctccacctcagctcagagcacagtgatgattcgtgactttcccaatagaacttcaaatctctgaggacggggggtggggggatgtgcttgagtgtttgtactcatggtcttgttctcggagtgacaaagctggaacacaatacctctatgcatgaaaaggttgtcacttgtcacaactaacaggctttcacctcaaggaaattttcttcccttgtgtacttttcccctggcagtggacatggctgcactcttccaagaagcaagcagctgtcccgtctgctcagactatctggaaaaaccaatgtccctggagtgtggatgcaccgtctgcctcaagtgcatcaattcgctgcagaaggagccccatggggaggatctgctttgctgttgctgttccatggtctctcagaggaacaaaatcaggcccaatcggcagctagagaggctggtttcccacatcaaggaactggagcccaagctgaagaagattctacagatgaacccaaggatgcggaagttccaagtggatatgaccttggatgccgacacagccaacaacttcctcctcatttctgacgacctcaggagcgtccgaagtgggctcatcacacagaatcggcaagaccttgccgagagatttgacgtgtccgtttgcatcctgggctcccctcgctttacctgtggccgccactactgggaggtggacgtgggaacaagcacagaatgggacctgggagtctgcagagaatctgttcactgcaaagggaagatccagctgaccacagagcttggattctggactgtgagtttgagggatggaagccgcctctctgccagcacggtgccgctgactttcctcttagtagaccgcaagttacagcgagtggggatttttctggatatgggcatgcagaacgtttccttttttgatgctgaaagtggttcccatgtctatacattcaggagcgtctctgctgaggagccactgcgcccatttttggctccttcaattccacctaatggtgatcaaggtgtcttgagcatctgtcctttgatgaactcaggcactactgatgctccagtccgtcctggggaggccaaataagccgccactgcaaaaaaaaacagggtcagaaaattacttgggtgggtagacttaggaattttctacttggtaaaagcattatacagtcataggagaaagatatgggacatttctataatctatattctaatttgattcgattattgagtcgtaagtattaattattgccaccatccaactcattgagtcttatggttcacatcttgtttcctatagaaatgttctgtattctcggatcaatttccaaatgctttactttttcatttctgtaagttcaaatcaatgtttaaattatagaagttatgaggtaaataaacatttggatatca

SEQ ID NO: 427 - DNA, 5200 bp, Homo sapiens
gaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgccgcagcacaaggctgcccaggtcgccaaggagaaaaagaagaaaaagaaaaagaagaaggcagaaaatgcagaaggacagacgcctgccattgggccggatggcgagcctctagacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctg

SEQ ID NO: 428 - DNA, 1851 bp, Homo sapiens
ggcacgaggcggagcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtgatggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgctaaagtaaataatgccagcctgattggactgggttatactcagacccttcgaccaggagtcaaattgactttatcagctttaatcgatgggaagaacttcagtgcaggaggtcacaaggttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaacataaaaaaaaaaaaaaaaaaaactcgaactagtctctctctctcaatggcgtcagttggtgagtgtccggccccagtaccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggtacgtgaaaaaaaaaaaaaaaaaaa

SEQ ID NO: 429 - DNA, 2277 bp, Homo sapiens
acatggcgaacgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtgacactgtcatcccactttacatcccacagtgtggagaatgcaaattttgtctaaatcctaaaactaacctttgccagaagataagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatgagagcagcacttgaggcatgtcacaagggctggggcgtcagcgtcgtggttggagtagctgcttcaggtgaagaaattgccactcgtccattccagctggtaacaggtcgcacatggaaaggcactgcctttggaggatggaagagtgtagaaagtgtcccaaagttggtgtctgaatatatgtccaaaaagataaaagttgatgaatttgtgactcacaatctgtcttttgatgaaatcaacaaagcctttgaactgatgcattctggaaagagcattcgaactgttgtaaagatttaattcaaaagagaaaaataatgtccatcctgtcgtgatgtgataggagcagcttaacaggcagggagaagcgcctccaacctcacagcctcgtagagcttcacagctactccagaaaatagggttatgtgtgtcattcatgaatctctataatcaaggacaaggataattcagtcatgaacctgttttctggatgctcctccacataaataattgctagtttattaaggaatattttaacataataaaagtaatttctacatttgtgtggaaattgtcttgttttatgctgtcatcattgtcacggttgtctgccattatcttcattctgcaagggaaagggaaaggaagcagggcagtggtgggtgtctgaaacctcagaaacataacgttgaacttttaagggtctcagtccccgttgattaaagaacagatcctagccatcagtgacaaagttaatcaggacccaagtctgcttctgtgatattatcttgaagggaggtactgtgccttgttcatacctgtaccccaaattcctaggatgcatctgccttcagggggcactaaaatgtattattgaaacagcattctgggcttaaataggtgtatgtatgtgttggttgtgactgtactattctagtatagtgaactacatactgaatatccaagttctcagcacctacttttgtcaaatcttaacattttgccacttcgagatcacattgccttcctcccctccaagaggtaacaattatccacaatttgatgtttatcattcctgtgttgttgtactttcactgtgtataacctaaaccatctactctttagtactgttttatatatttttaagcctcatacttgctcattctacagcttttttcactcattattgtataattatatctgaagctctcgttcattaattttagtcctgtgtagcagaattcaattacgggaaactaccataatttatctgttctccagtccagttgaaggcatgaagttgttgccagtttctgtattataacactgtagtggaacattcttctgcattgggctactcgcgtgttacctaagacgtatcacagaataaacacatttagccttatagacattgccaaattgctcttcaaagtaaatgtgagtttttgtg

SEQ ID NO: 430 - DNA, 4190 bp, Homo sapiens
caacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactcaaaaaaaaaaaaaaaaaaa

SEQ ID NO: 431 - DNA, 985 bp, Homo sapiens
gcctttccgtcaattcctgtcctgggcgtacgtcaagatggcggcgtctgtattaaacaccgtgctgaggcggcttcctatgctatctctcttccgaggttctcacagagttcaggttcccctccagactctttgcaccaaagctccctctgaggaagattctttgtcctcagttcccatttctccttataaggatgagccctggaaatatctggaatcagaagaataccaggagcgatatggttctcgccccgtctgggctgactaccgccgcaaccacaagggtggtgtacccccacagcggactcggaagacatgtattcgtcggaataaagttgttgggaatccctgccccatctgtcgagatcacaagttgcatgttgactttaggaacgtgaagctcttggagcaatttgtctgcgcccacacgggtatcatcttctatgctccatacacaggagtctgtgtgaagcagcacaagcggttgacccaggccatccagaaagccagggatcatggtctcctcatttaccacatcccccaggttgaaccacgggaccttgacttcagtacctctcatggggctgtgagtgctactccgccagcccccaccctggtctcaagtgacccctggtacccatggtacaactggaaacagccaccggagagagaactgtctcgccttcgccggctttaccagggtcatctccaagaagagagtggccccccacctgagtcaatgcccaagatgccccctagaacaccagcggaagcctcctccactgggcagacaggccctcagagtgctctgtaggagctgtagactgggaagagaggccaggcgtggtggctcactcctgtaatcccagcactttgggaagccaaggtgggctgatcacttgatcccaggagtttgagaccagcctgggcaccatggtgaaacctcgtctttaccaaaaaaaaaaaaaaaaaaaaaaaaaaaaaa

SEQ ID NO: 432 - DNA, 965 bp, Homo sapiens
cagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctggagtttttgaattccaaaccttatactgaataactactgaatccctttactgttaaatttttttccaaactttcaagatatatttagttgtgtttaactgctacttggagctcagaagccactttatcagttttcctcactggttggatagcctatcagtttatggaaggatataacttccgtaagttacatccttatggaagctactgaataaaagaagggggtatgcaccccctagtttgccaagattgagaaatagcctcttcactggtatgcaaacagatttgattttgcatcctatcatttaaaaagaaattatgtctgcaccccaacataggcatacttaagtaatatacatactcctgtgctaacatgtatactagaaaacaaaaagatgttagaaaaataaaagtataaagacaaatcaaaaaaaaaaaaaaaaaaaaaaaaaaaa

SEQ ID NO: 433 - DNA, 4053 bp, Homo sapiens
gaattcgcggccgcgtcgaccaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagcagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtgacccaatgttgtcttccagttgtgaaagcaccccagagacccactatccaagtttcactctagcgtggaggcagggcaggcagccctgatcaaatatctcctacacaattcgtttacttcgtttgaatgttagagccacttgtgattatttttttgtgtttctaacttacagtttaaatttatttgtaaaaagttaaaggatagtgggtctttgtgtggctttccctgctgttcactctggcatctttagcatttttcttcttttttaatttgataattgtaggtcattagcatgcatattgagtttgcccttatgtggtgggagttcaaacacacaaagacccactatttgcacaaactattcttactggtttggaataggctgccatgcttttttaatgttattgcaacatgtgtattcatttacagaattcagataaaatttgcttatgttctgctattatgtttgatctaatcctaatcacagtgagctcttaattagctcaatatgtggtttgccctcaagtgtgcactgtttattactttgtaatatgccactatgagtactgacatttagatatgtttaaaggccaaaaactggaaacagccatgccctgttttctgtgtatttgggatgggaataacaacattttgggggagctttttaaatctcagagaaaaggaaagtggcctgctctggcaggtatgtgcagtgtttcatttgttccagtcccaaaaatgagcactgtcctatggtagttcgcttaggatctttatgtgctctgggctaatgaaggtactgcatcatgtgctgcagcgtgtgtattctttttcgatgacctataaagggattatttttgaggaatgaaaggctcccatcattgactgtgagatgggaaaaacctttcctagcttagagcatttatatcttaatccattttaaagtcagagttcattgttacctgttttaatcaggtgactacatgtcccagtatacaaaggggcactggttgacattcttcttaatgtatttagtaaatatcataagaaatcctttaagagtttaaatgtccccaaaacagacatgcgggctctagtcaagaatgaattagagtgaaggaaagctgtgtaacacctggcattcctctgtgttcatggagcttctttgaggctctaagattgattttaccatcagacttctctaatacctgttcttcaaccatattggctactttgacataagaatttacttcttttcctggaatggaaaacactttaaaaaataataacaaacattattataaactaatatatgtgagagtacttagttgatacaaaaaggagttttagtagacagtattatactatatttgaaaatcaaggagaattttatgcaacttaaaatgtttacaaactgcagtgcaatctactgtttgtgaatgtcaaagtatcaggaaaagtgtatatacaatcacagagtcatatttcctcacaaagttatttacaaagagtgaaatatgtttttgtacctctcagtttcagttagaggcatattttgtgcaatatttatgttaatgtgcctatacattatgaatgaattatttcagtcatacattgcctaaatcataactttatgatgcttgggaaagaatcaacagttaaaacttcataaagttctaatgtctgtgttccaaaatacatcacattattaggatgtagggagataagtatgtgtgctccctagggtggcaatttctagttactagaccacctctatttttagcatttggcatcctcatgatacttttataaatatgacattaataggaaagcaataatttcattttacagatagaataacagatttgcctgcattcactgaaagagtgcaaagactgggtccttgtgaattcaactgactctcccaaattgtattaattacctgttcttgccttttattttctgaacttgctgcttttgcattcttttgagttcaaagacagttactttaaatccatttttaaaccctcggggtagaaatcataccactgttaatcagccacattatttggtctaaggttttttctttataattctgaaactgagtttatctaatacattgatgaattatttcaaacgtatttttatagttcaaatcagttcacttttacactgataaatataaattactaggaatgaccttcagacagcgtttagcatctgtaaccaacctgaaaataatatgttcatcaggtacctatggattaaatcatatactggcgtatttaagctgaatgtcagtctggaaaataaatttactatattaactgaaataccactctttgtgtaggtattttgtcatgtatttaagaaaaagataaaaagaatggaaatcatatgacataataacttaagtctttcttaaaagtgcatgctgtcttttgcaatacctcattcagccaagtatttgttctcttcctcattcagtataagtcagctttcaatttgcttagaaggcaacattagaaggttagagttcatcagaaacatagaattttaaaatgtgagttcaactgaataaatttgaatttctgtaggaggtaaagaatcaaaatacctgtttaaagattgcaattgcaatgtataataatcacttttaaattatttgattaaaccttttaggttttccagaaatgaaaaaaatcagttctaaaaccaaagctgatttttagaaaatttgagaatgtaaatcagccctatccataatatagtttctctaaaactttatcttaaagagtcattttaaaataatataactattaaaaatgtaactgatatttaaatgttttgaaataaaacattttaaaatataaatactgtagtttaaaagaaagaaactgggggaaagaaaagtagagaaagaaataccaattccagtccaaagctttatttgccagttttcttagaatgacttttaccagtttatgaattcttgtaaacagaatctataatggaaatactgaaagacttttgcctaaagtggcattattgaatgctgctgtgatgctactgtaatgtaataaattattaaattgttgcaaagtgctgtttttgccttaaaattttattttgtgtgtcttgaaaattatagtattaaaggtattgagattgtgcaaatgctgggcacgcttggcatgagataatctgtttttatttttaccaaattgtaatataactatgcaagtgtgtttattaaaagaacaccaactataaaaaaaagtcgacgcggccgcgaattccagctgac

SEQ ID NO: 434 - DNA, 781 bp, Homo sapiens
ggcacgagggtgtcctgcgcgctacgccgtctgtttctagggcaacgccggcgtctcttagcaaccgcgcgcggcctaggtgggtccccccggcacccccagacctgccatggcgaccgcgagtcctagcgtctttctactcatggtcaacgggcaggtggagagcgcccagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagtttgtgcctggtcgcctcctcagatctgcaagctgctccacccactgaggacaaatagaaacaggtcccctgggagtgctgagtcacggggctcccttcagccctgttccagcagcagaaggccgggcgattttaccctgtgccctgtgaaaaatctttgtgtctgagggagcagaggaaaaactcttgtcagatgggaaaaatgctcatgacataatgtgacattaaaaggtgggaaacaagaggatataaaaaaaaaaaaaaaaaa

SEQ ID NO: 435 - DNA, 5175 bp, Homo sapiens
  modified_base (4596)..(4596): a, c, g, or t
gctgctgctgcagtgggacaggtggcggcgaccggcggcgtccgaggagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgaggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgagaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagcttttcacctcgaattttgttttcttgatttttacgtttgaagacattgcaccagatgcnattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactagggaattccg

SEQ ID NO: 436 - DNA, 653 bp, Homo sapiens
  modified_base (330)..(330): a, c, g, or t
aggaggagccgtgtgccctggcactgagcggccgcggggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggnttttgttttactgccctaatgggaatgttcaattccatatttgatggtagagtggtggcaaagcttccttttacccctctttcttacatccaaggactgcctcatcgaaatctgctgggagatgacaccacagactgttccttcattttcctgtatattctctgactatgtcgattcgacagaacattcagaagattctcggctttgccctttaacagccggcaccaagcagcaggtggattttttgggccaccacctccttctggaagtttttttgaacttaagacctattattttctattatcttttttagaccacacact

SEQ ID NO: 437 - DNA, 2540 bp, Homo sapiens
gaattccgcgccagggccgaccgttcttcctgtactacgcttcccaccacactcactaccctcagttcagtggacaaagcttcaccaagcgctcaggccgtgggccatttggggactccttgatggagctggatggagctgtaggggccttgatgacaactgtgggggacctcggtctgctggaagagacactagtcatcttcactgcagataacggtcctgagttgatgcgcatgtccaatggcggctgctctggcctcttgagatgtggaaaaggaacaacttttgaaggtggcgtccgagagcctgccttggtctactggccaggtcacattactcctggtgtaacccatgagctggccagctctctggacctgctgcccaccctggcagccctgaccggggtccgctgcccaacgtcaccttggatggtgttgacatcagccccttgctgctaggcacaggcaagagcccacggaagtctgtcttcttctacccgccctacccagacgagatccatggggtctttgctgttcggaatgggaaatacaaggctcatttcttcacccagggctccgcccacagtgacaccacttcagatcctgcctgtcatgctgccaaccgtctgacggctcatgagcccccactgctctacgacttatctcaggaccctggggagaactacaatgttttggaaaaccacagagggaagagatgggaaaatggctgtccaggagttttcggaattcgggttactgctgcagcttttggggtcgcccggccgccgctattacagtcttcccccgcatcagaaggttccattgccttctctttcccccacaatgcaggcaggcaccatagcccgttgggaaaaaaaagagggggacaaaatcaatgaaggtgacctaattgcagaggttgaaactgataaagccactgttggatttgagagcctggaggagtgttatatggcaaagatacttgttgctgaaggtaccagggatgttcccatcggagcgatcatctgtatcacagttggcaagcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtacttcttcctgccctctctcccaccatgaccatgggcacagttcagagatgggaaaaaaaagtgggtgagaagctaagtgaaggagacttactggcagagatagaaactgacaaagccactataggttttgaagtacaggaagaaggttatctggcaaaaatcctggtccctgaaggcacaagagatgtccctctaggaaccccactctgtatcattgtagaaaaagaggcagatatatcagcatttgctgactataggccaaccgaagtaacagatttaaaaccacaagtgccaccacctaccccacccccggtggccgctgttcctccaactccccagcctttagctcctacaccttcgacaccctgcccagctactcctgctggaccaaagggaagggtgtttgttgaccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattaccttctatcgtgtaaatatggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagcccgaattc

SEQ ID NO: 438 - DNA, 1107 bp, Homo sapiens
gggaaattaagtttcttgcggagtacggtggggattgcagctgctgagcagggattctggaaagcattgcgtacctgagcccccagcatggcgggcctaaagcggcgggcaagccaggtgtggctagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtggtgaggaaattcaagggttccagagatggagcagacttgaaggagaatataaagaactgctgggacactgggcagtttatgctattcagtacatcagactgcgggttcgggctgaatactgccagcatgagactgctctgcagggcaatgtcttctctaacaagcaggacccacttgagcgccagtttgagcgctttaaccaggccaacaccatcctcaagtcccggacctgggctccatcatctgtaacatcaagttctctgagctcacctacctcgatgcattctggcgtgactacatcaatggctctttattagaggcacttaaaggtgtcttcatcacagactccctcaagcaagctgtggggccatgaagccatcaagctgctgggtaaatgtaggacggagggagggactatggaggctggggccgacaggaaa

SEQ ID NO: 439 - DNA, 1381 bp, Homo sapiens
tgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaataccaaccaaattgtcgccattaagaaagagtctctgctggtagccactacagctgtgaatgtgctgtgtcatacctgaagccaatatgtctcggagtttcacctgaggcccatgatcaaacttggacatagatcagaagctaaagatggtataaatagaaccgccttaagagagataaaattattacaggagctaagtcatccaaatataattggtctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagattttggcctggccaaatcttttgggagccccaatagagcttatacacatcaggttgtaaccaggtggtatcgggcccccgagttactatttggagctaggatgtatggtgtaggtgtggacatgtgggctgttggctgtatattagcagagttacttctaagggttccttttttgccaggagattcagaccttgatcagctaacaagaatatttgaaactttgggcacaccaactgaggaacagtggccggacatgtgtagtcttccagattatgtgacatttaagagtttccctggaatacctttgcatcacatcttcagtgcagcaggagacgacttactagatctcatacaaggcttattcttatttaatccatgtgctcgaattacggccacacaggcactgaaaatgaagtatttcagtaatcggccagggccaacacctggatgtcagctgccaagaccaaactgtccagtggaaaccttaaaggagcaatcaaatccagctttggcaataaaaaggaaaagaacagaggccttagaacaaggaggattgcccaagaaactaattttttaaagagaacactggacaacattttactactgagggaaatagccaaaaaggcaaataatggaaaaatagtaaacattaagtaaatgctgtagaagtgagtttgtaaatattctacacatgtaaaatatgtaaaactatgggttatttttattaaatgtattttaaaaa

SEQ ID NO: 440 - DNA, 5099 bp, Homo sapiens
  modified_base (45)..(46): a, c, g, or t
  modified_base (73)..(73): a, c, g, or t
  modified_base (3089)..(3094): a, c, g, or t
  modified_base (3096)..(3096): a, c, g, or t
  modified_base (3099)..(3102): a, c, g, or t
  modified_base (3104)..(3106): a, c, g, or t
  modified_base (3109)..(3109): a, c, g, or t
  modified_base (3111)..(3111): a, c, g, or t
  modified_base (4273)..(4280): a, c, g, or t
  modified_base (4282)..(4282): a, c, g, or t
  modified_base (4332)..(4338): a, c, g, or t
  modified_base (4340)..(4340): a, c, g, or t
  modified_base (4342)..(4343): a, c, g, or t
  modified_base (4345)..(4346): a, c, g, or t
  modified_base (4348)..(4349): a, c, g, or t
  modified_base (5001)..(5001): a, c, g, or t
  modified_base (5082)..(5082): a, c, g, or t
aattcgcggccgcgtcgactacggctgcgagaagacgacagaagnngacctccatcagctcgccgcgcagcgnggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattannnnnnanaannnnannnaanantgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttgannnnnnnnantcatattctttcagaatcatgtaaataaatggcatcatgttgtaaaaaannnnnnnanannannanngttaaaaatatgggctgaactttttatggacttgatttttatgactattggtatctaaaggtcaaggaagccatttacattattttggatgaatctactatacatctatggaaatgtctcttttattttaaattctggtttctcaacggaaaatttcagaaaagatgccccttgccattttcgttaatttttcagtcttttcttagacacacccccagcctaagaccttgttcgaggagtttattgtgtctgtcttttcttaacatactgcactgttcttaagcatcatattgtgttgtttttatttagccactattaacatgaaggtttattcaggtagatttgatttcctttgcttcgtttcttctcctgctctgtcaactgtacttatcttaaagggccactctaaaaacaagggagatgtcgtaatctgaaacctttggggagatgtactctgtactgcataacatctccagtgaggtttgtgacaggacctcaactaaatatatgaatttgtgcaagttcatatattaaagtttctgcagcagagtgaaaattgttacagtaaatgtggtagaaactgttaatcgcttaatgccagtttaaatcatgttttgtaaccaagcttcagtaaaaggctttagattgtcanagttggttgatttttagaattgtatatataaagaattagacattaaacaggcatattctagtgtctgaaaatacacataanaaatttctattaaaaaa

SEQ ID NO: 441 - DNA, 1665 bp, Homo sapiens
  modified_base (16)..(26): a, c, g, or t
  modified_base (49)..(50): a, c, g, or t
  modified_base (648)..(648): a, c, g, or t
  modified_base (1488)..(1488): a, c, g, or t
  modified_base (1494)..(1496): a, c, g, or t
  modified_base (1498)..(1498): a, c, g, or t
  modified_base (1507)..(1508): a, c, g, or t
  modified_base (1515)..(1515): a, c, g, or t
  modified_base (1518)..(1518): a, c, g, or t
  modified_base (1525)..(1525): a, c, g, or t
  modified_base (1563)..(1563): a, c, g, or t
  modified_base (1577)..(1578): a, c, g, or t
  modified_base (1619)..(1619): a, c, g, or t
  modified_base (1638)..(1638): a, c, g, or t
ctagttctagatcgcnnnnnnnnnnnttttttttttttttttttttttnnggtttttaaaaggctttattggggaaacgtagaggggtggggaccgtccttggaggcctcaggacaccatcctccatgttgctgggcagttgaagtccccaggggcccctgctcagaagcgtgtcaccagtctctgcgggggcctcatctgtgactcctggaggggcccagcccggggtaaccactacccccccatccctcgttgctgttgctcctgctccaggttccgctgcaggacctgctgctggttggcaatgacacgccggatgccgttgacaaagttgccctggtcatgggggatgaggccaatgaagattttcttctctgaagagtacaggagcataagcacgcggatctcacacgatgctttgtaggaaaagtgcacgcagccggcgaagccattgtccatgatccggcacaggctcttcagtgtctccaggtccttggtgaagtggaactggaccaggcgcgagttccggaacagcggcactagggtggtcagcagctgctgcgggatgagctgcatgtacagcttccttggccactgctcggtcctcaggatctccccctggttcacgtagacgtgggatggcagccnacctcttggaccgactgttgggctcaggcctgggctcctgccactccatgacaccactccatgccagaaacttgttgttgacgatctggactgggcctgagttgacaccaccaggtcccactgcctgcttgcgggtggtgatgacctgccggatggcactgacgaagccgctctggtcgtaggggatgaggcccatgaagatcttcttcttggacgagtacaggagcatgagcacgcgcacctcacagggggagatgtgggggaacagcatgcagcccgcgaagccgttgcccatgatgcggcagagccccttgagcgagtcgcagtctctgttggtgaagtggaactgtgccaactgggagttccggaacagggggcccagggtggtcagcagctgctgagggatcagctgcatgatcagcttctgcggccactggtcggtctccaggttctcgccttggttcacgtaggcttggcagggcagggtccgcttcagctttgcagtggagtcagagtagggtctgcgcttctcctgccactcgaggacgccgctccaagccagcagcttgttgctgagccggtgctcgctcacggccagacccccgagggtgagcccaggtgaggagggaccgatgggacccagtgccccgaagacccgagcaccttccatgggaggggccgagcgggcccggatccgcggaggctgcgggcctcgggggctggcaggccaggagcgcgagcggacggcgcgcaccacgaggggccgcggagggcggccgcgacccccgagggggcccccggcgccggagcggtacggggcacggcgcggacggaccatgncgggcnnngnccgagcggnncgggganctnccgcggnccacaaggggggctgcgggctccaccgactgaggggcncgggcgcgggcgcnnggcttcgggggagacgggctgagccgtaccaagctcggggnacgcgccgccggagtgggntcgccgcggccgaaccactgaggcgag

SEQ ID NO: 442 - DNA, 6750 bp, Homo sapiens
  modified_base (28)..(28): a, c, g, or t
  modified_base (72)..(72): a, c, g, or t
  modified_base (117)..(117): a, c, g, or t
  modified_base (129)..(129): a, c, g, or t
  modified_base (137)..(137): a, c, g, or t
  modified_base (142)..(142): a, c, g, or t
  modified_base (216)..(226): a, c, g, or t
  modified_base (377)..(377): a, c, g, or t
  modified_base (656)..(656): a, c, g, or t
  modified_base (2264)..(2264): a, c, g, or t
  modified_base (2545)..(2545): a, c, g, or t
  modified_base (2802)..(2802): a, c, g, or t
  modified_base (2844)..(2844): a, c, g, or t
  modified_base (4723)..(4723): a, c, g, or t
  modified_base (4882)..(4882): a, c, g, or t
  modified_base (5620)..(5620): a, c, g, or t
  modified_base (5957)..(5957): a, c, g, or t
  modified_base (6611)..(6611): a, c, g, or t
  modified_base (6615)..(6615): a, c, g, or t
  modified_base (6625)..(6628): a, c, g, or t
acacgcgcttcaacttcggttggtgtgngtcgaagaaacctgactgcgccctgaggagaacagcggagaagngtccaccgagcctggcgaaaggtccgctgagcgggctgtcgtccnggagccactccngggctgcnggagnacccagtggagaccgcgcctggctcaggtgtgggaccccatccttcctgtcttcgcagaggagtcctcgcgtgnnnnnnnnnnnaaataagcgggttttgaaaacaaaaaaaagaaggagtggaagagggggccaggatccaggcctccatccccacagaagtgaagctacagctgggaggtctcctcccaccccaaccgtcaccctgggtcccgactgcccacctcctcctccnccccctccccccaacaacaacaacaacaacaactccaagcacaccggccataagagtgcgtgtgtccccaacatgaccgaacgaagaagggacgagctctctgaagagatcaacaacttaagagagaaggtcatgaagcagtcggaggagaacaacaacctgcagagccaggtgcagaagctcacagaggagaacaccacccttcgagagcaagtggaacccacccctgaggatgaggatgatgacatcgagctccgcggtgctgcagcagctgctgcncccaccccctccaatagaggaagagtgcccagaagacctcccagagaagttcgatggcaacccagacatgctggctcctttcatggcccagtgccagatcttcatggaaaagagcaccagggatttctcagttgatcgtgtccgtgtctgcttcgtgacaagcatgatgaccggccgtgctgcccgttgggcctcagcaaagctggagcgctcccactacctgatgcacaactacccagctttcatgatggaaatgaagcatgtctttgaagaccctcagaggcgagaggttgccaaacgcaagatcagacgcctgcgccaaggcatggggtctgtcatcgactactccaatgctttccagatgattgcccaggacctggattggaacgagcctgcgctgattgaccagtaccacgagggcctcagcgaccacattcaggaggagctctcccacctcgaggtcgccaagtcgctgtctgctctgattgggcagtgcattcacattgagagaaggctggccagggctgctgcagctcgcaagccacgctcgccaccccgggcgctggtgttgcctcacattgcaagccaccaccaggtagatccaaccgagccggtgggaggtgcccgcatgcgcctgacgcaggaagaaaaagaaagacgcagaaagctgaacctgtgcctctactgtggaacaggaggtcactacgctgacaattgtcctgccaaggcctcaaagtcttcgccggcgggaaactccccggccccgctgtagagggaccttcagcgaccgggccagaaataataaggtccccacaagatgatgcctcatctccacacttgcaagtgatgctccagattcatcttccgggcagacacaccctgttcgtccgagccatgatcgattctggtgcttctggcaacttcattgatcacgaatatgttgctcaaaatggaattcctctaagaatcaaggactggccaatacttgtggaagcaattgatgggcgccccatagcatcgggcccagttgtccacgaaactcacgacctgatagttgacctgggagatcaccgagaggtgctgtcatttgatgtgactcagtctccattcttccctgtcgtcctaggggttcgctggctgagcacacatgatcccaatatcacatggagcactcgatctatcgtctttgattctgaatactgccgctaccactgccggatgtattctccaataccaccatcgctcccaccaccagcaccacaaccgccactctattatccagtagatggatacagagtttaccaaccagtgaggtattactatgtccagaatgtgtacactccagtagatgagcacgtctacccagatcaccgcctggttgaccctcacatagaaatgatacctggagcacacagtattcccagtggacatgtgtattcactgtccgaacctgaaatggcagctcttcgagattttgtggcaagaaatgtaaaagatgggctaattactccaacgattgcacctaatggagcccaagttctccaggtgaagagggggtggaaactgcaagtttcttatgattgccgagctccaaacaattttactatncagaatcagtatcctcgcctatctattccaaatttagaagaccaagcacacctggcaacgtacactgaattcgtacctcaaatacctggataccaaacataccccacatatgccgcgtacccgacctacccagtaggattcgcctggtacccagtgggacgagacggacaaggaagatcactatatgtacctgtgatgatcacttggaatccacactggtaccgccagcctccggtaccacagtacccgccgccacagccgccgcctccaccaccaccacngccgccgcctccatcttacagtaccctgtaaatacctgtcatgtccttcaggatctctgccctcaaaatttattcctgttcagcttctcaatcagtgactgtgtgctaaattttaggctactgtatcttcaggccacctgaggcacatcctctctgaaacggctatggaaggttagggccactctggactggcacacatcctaaagcaccaaaagaccttcaacattttctgagagcaacagagtatttgccaatanatgatctctcatttttccaccttgactgccaatctaactaanataattaataagtttactttccagccagtcctggaagtctgggttttacctgccaaaacctccatcaccatctaaattataggctgccaaatttgctgtttaacatttacagagaagctgatacaaacgcaggaaatgctgatttctttatggagggggagacgaggaggaggaggacatgacttttcttgcggtttcggtaccctctttttaaatcactggaggactgaggccttattaaggaagccaaaattatcggtgcagtgtggaaaggcttccgtgatcctctcgctgcacccttagaaacttcaccgtcttcaaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactccattttgctgccacacacagagatgtaagaggcaggctttaattgccaaagcacagtttgagcagtagaaaacaacatggtgtatatctcaaattgcctgacatgaagaggagtctaacggtgaagtttcacttttcatcagcatcatctttcacatgttcattatcatccgctcttattcttgcatgtttaaacacttaaaatttttagtataatttttagtgtgttttgaagtggtgactaggctttcaaaaacttccattgaattacaaagcactatccagttcttattgttaaactaagtaaaaatgataagtaacatagtgtaaaatattcctttactgtgaacttcttacaatgctgtgaatgagaggctcctcagaactggagcatttgtataataattcatcctgttcatcttcaattttaacatcatatataatttcaattctatcaattgggcctttaaaaatcatataaaaggatataaaatttgaaaagagaaacctaattggctatttaatccaaaacaacttttttttnccttcaatggaatcagaaagcttgtcaatcactcatgtgttttagagtaattacttttaaaatggtgcatttgtgcttctgaactattttgaagagtcacttctgtttacctcaagtatcaattcatcctccatacatttgaattcaagttgttttttngtcaaatttacagttgtcaattgatcttcaagctgcagggtgcctagaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattctatagttttgaagtttggttaagtttcctttcactcaattgatttattttgttgttaatcaaatttatgttaattggatcctttaaattttttttggcattttccaacaaaaatggctttattcataagaaaggaaaaaaatcaatggaatttgatatctaaagaagttagaaagggagcaaaataaaaaacataaaggagatagatgaattagtaagcaaatcagtagtcgagtttttcaaactggcaaaattaattaattgacttttagcccaaatttacattgttaattaaatcaagaaggaagaagatctaagagctcccattgataggcaagcctagagagaactagctaaatttatcatgctaggatattgaaacacagaaagtttacatacatttatgaagggtcaatttagtttggnacagtgaggtatttgtcttagtggaaaaaaggagaattagtctgatcaaatcgtgaagtaatacagtgaacttgcaggtgcacaaaataagagggccacatctatatggtgcagtctggaattctgtttaagtttgtaggtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgtngttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgcaaaaaaaaaaaaaaaaaaaaaaanaaanaaaaaaaaannnnagggggggcccggtacccaattcgccctatagtgagtcgtattacaattcactggcccgcgttttacaacgtcgggactgggaaaaccttggcgttacccaacttaatcgccttgcagaata

SEQ ID NO: 443 - DNA, 8288 bp, Homo sapiens
  modified_base (332)..(332): a, c, g, or t
  modified_base (347)..(348): a, c, g, or t
  modified_base (350)..(352): a, c, g, or t
  modified_base (563)..(564): a, c, g, or t
  modified_base (1111)..(1112): a, c, g, or t
  modified_base (1219)..(1219): a, c, g, or t
  modified_base (1226)..(1226): a, c, g, or t
  modified_base (1233)..(1233): a, c, g, or t
  modified_base (1235)..(1235): a, c, g, or t
  modified_base (1272)..(1273): a, c, g, or t
  modified_base (1863)..(1863): a, c, g, or t
  modified_base (1906)..(1906): a, c, g, or t
  modified_base (1910)..(1910): a, c, g, or t
  modified_base (2144)..(2144): a, c, g, or t
  modified_base (2146)..(2146): a, c, g, or t
  modified_base (2413)..(2413): a, c, g, or t
  modified_base (2486)..(2486): a, c, g, or t
  modified_base (2492)..(2492): a, c, g, or t
  modified_base (2494)..(2494): a, c, g, or t
  modified_base (2511)..(2511): a, c, g, or t
  modified_base (2516)..(2516): a, c, g, or t
  modified_base (2522)..(2522): a, c, g, or t
  modified_base (2539)..(2539): a, c, g, or t
  modified_base (2544)..(2544): a, c, g, or t
  modified_base (2555)..(2555): a, c, g, or t
  modified_base (2560)..(2560): a, c, g, or t
  modified_base (2572)..(2572): a, c, g, or t
  modified_base (2596)..(2596): a, c, g, or t
  modified_base (3848)..(3849): a, c, g, or t
  modified_base (3853)..(3853): a, c, g, or t
  modified_base (3857)..(3857): a, c, g, or t
  modified_base (3868)..(3869): a, c, g, or t
  modified_base (3877)..(3877): a, c, g, or t
  modified_base (3913)..(3913): a, c, g, or t
  modified_base (3920)..(3920): a, c, g, or t
  modified_base (4493)..(4493): a, c, g, or t
  modified_base (4508)..(4508): a, c, g, or t
  modified_base (4510)..(4510): a, c, g, or t
  modified_base (4512)..(4514): a, c, g, or t
  modified_base (5665)..(5665): a, c, g, or t
  modified_base (7579)..(7579): a, c, g, or t
  modified_base (7653)..(7653): a, c, g, or t
  modified_base (8106)..(8106): a, c, g, or t
  modified_base (8223)..(8223): a, c, g, or t
  modified_base (8225)..(8225): a, c, g, or t
ttacaatcgaagcaagcgacaaggagacatctggaacaaacgggtggaagtgcagtgccttgctcttgctggaggtgctgggtggctcccacaagcacgccgtggatggtgctgtgaaggaaactcacgaagctgtggaaagagaaccccgggctggtggaacagtacttgtcagccattctcagcctagagcccaaccagaactatgctggcatgctggggctgctggtgcagttctgcacgagtcacaaggagatggacgtggtcagtcagcacaagagcgccctactggacttttacatgaagaacatcctgatgagcaaagtcaagcntccgaagtacctgtnngnnngctgtgcccctctgctccgatacctgtcccactcagaatttaaggatctgatactgcccaccatacagaagtccttactgaggagtccagagaatgttattgaaactatttctagtctgctggcatcagtgacgcttgacctcagccagtatgccatggacatcgtgaaaggactggctggtcacctgaaatccaacagtccccgcctganngatgaagctgtgctggcactgcggaacctggcacgccagtgcagtgactcttcggccatggaatccctgaccaagcacctatttgctatcctcggaggctcggaaggaaaactaactgttgtagcccagaagatgagcgtcctctcagggattgggagcgtcagtcatcacgtggtgtctggaccttccagtcaggtcctgaatgggatcgtggctgagctgttcatcccgttccttcagcaggaagttcatgaagggaccttggtacacgctgtctcagtcctggctctctggtgtaaccgattcactatggaagtgcccaagaagctcactgaatggttcaaaaaagctttcagccttaaaacctccacatctgcggtgaggcatgcctacctgcagtgcatgttggcctcttaccggggtgacacgctgttgcaggccctggacttactgcccttgctcatccagacagtggagaaggcagcctcccaaagcactcaggttcccaccatcaccgaaggggttgccgcagccttgttgctcttanngttgtcagtggctgactcacaggctgaggccaaactgagcagtttctggcagttgattgtggatgagaaaaagcaggttttcacttctgagaaattcctggtcatgncttcagnaggatgncnctgtgtactgtgttgcatctgacagagagacttttcnntgaccacccgcatagactcactggcaacaaagttcagcagtaccaccgggctctggtggcggtgctcctgagccgcacctggcacgtccgcaggcaggctcagcagacagttcggaagctgctgtcctctcttgggggctttaagctggcgcacggactcttggaggagctgaagactgtcctcagttctcacaaggtgctgcccttagaggctttggtgactgatgctggagaggtgactgaggcaggcaaggcctacgtgcctccacgggtcctgcaggaggctctgtgtgtcatctccggtgtgccagggctcaagggtgatgtcaccgacactgaacaactggcccaggaaatgctgatcatctcccaccacccatccttagttgccgtgcagtctggactttggccagcacttcttgccaggatgaagatcgatcctgaagcctttatcaccaggcacctggatcagatcattcccaggatgaccacacagagtcccctaaaccagtcctccatgaatgccatgggctccctttccgtcctgtcgccggaccgggtcctcccacagctcatcagcaccatcactncctccgtgcagaaccctgcactgcgcctggtgacgcgggaggngttngccattatgcagacccctgctggggagctgtatgacaaatccatcattcagagtgcccagcaggacagcataaaaaaggccaacatgaagcgagagaacaaagcttattccttcaaagagcagatcatcgagctggagctgaaggaggagataaagaagaagaaaggcatcaaagaggaggtgcagctgaccagcaagcagaaggagatgctgcaggcccagctagacagggangngcaggtccggaggcggctgcaggagctggatggggagctggaggcggcgcttggactgctggacatcatcctggccaagaacccgtccggcctgacccagtacatccctgttttggtcgactcttttctgcccttgctgaagtctcccctggctgctcccaggatcaagaaccccttcttgtccttggctgcctgtgtcatgccctctaggctcaaggctttgggcactttggtgagccacgtgaccctgcgcctgctgaagccagnagtgtgtcctggataagtcctggtgccaggaagagctgtcggtggctgtgaagagggcggtgatgctgctgcncacccnanaccatcaccagcagggngggcnaggggnagccaggtgctgcgccnttgtnccgcgccagcnttctncttagtcttccngtttctgaagatggtgctgacggngatgccccaccacagtgaggaggaggaggagtggatggcccagattcttcagatcctcactgtccaagcccagctgagggcctcccccaacaccccacccgggcgggtggacgagaatggcccggagttgctgcctcgcgtggccatgctgcgtcttctgacttgggtgatcgggacgggctcgcctcgcttacaggttctggcttcagacaccctgaccaccctgtgtgccagcagcagtggtgatgatggctgtgcctttgcagagcaggaggaggtggacgtgctgctctgtgccttgcagtccccgtgtgccagcgtgcgggaaaccgtgctccgggggctgatggaactccacatggtattgccagcacctgatactgatgagaagaatggcctgaaccttctgcggagactctgggtggtcaagtttgacaaggaggaggagatccggaagctggctgagaggctctggtcaatgatgggcctagacctgcagccagacctctgctccttgctgattgacgacgtgatctatcatgaggcggctgtaaggcaggcaggggccgaagccctctcccaagcagtggcacgttaccagcggcaggcggcggaggttatgggcaggctcatggagatttaccaggaaaagctctaccggccgcccccagtgctggatgctttgggacgagttatttcagaatctcctccagatcagtgggaagccaggtgtggcttggcgttggccctcaacaagctctcccagtatttggacagctctcaggtgaagccactctttcagttttttgtccctgatgccctcaatgaccgacacccagatgtccggaagtgcatgttggatgcagccctcgcaacgctcaacactcatgggaaggagaacgtcaactcgctgttgccagtattcgaggagttcctgaagaacgcgcccaatgatgccagctatgatgctgtgcgacagagtgtggtggtcctgatgggctctctggccaagcacctggacaagagtgaccccaaagtgaagcccattgttgccaagctcatcgctgccctctccaccccctcccagcaggtccaggagtccgtagccagctgcttgccacccctcgtgccagccatcaaggaggatgctggagggatgatccagaggcttatgcagcagctgctggagtcagacaagtacgcagagcgcaaaggggccgcctatggcctggcgggcctggtgaagggcctnngcancctntcgctgaagcnncaggagangatggcggcactgactgatgccatccaagataagangaacttncgccggcgagagggagccctctttgccttcgagatgctctgcaccatgctggggaaactttttgagccgtatgtggttcacgtgctgccccatctgctcctgtgctttggggatggaaaccagtatgtgcgtgaggctgcagatgactgtgccaaggctgtgatgagcaacttgagtgctcacggggtgaagctggtgctcccctccttactggctgccctggaggaggaatcgtggcggaccaaagctgggtcagtggagcttcttggggcaatggcgtactgtgctcctaagcagctgtcatcctgtctacccaacattgtgcccaagcttacggaggtgctgaccgactcccatgtcaaagtccagaaggctggacagcaggcgctcaggcagatcggctccgttatcaggaacccggagatcctggccattgctccagtcctcctggatgccctgacggatccctccaggaagacccagaagtgcttgcagaccctgctggacaccaagtttgtccacttcattgatgccccatccctggccctcatcatgcccattgtccagagagcnttccaggaccgttcnangnnnacgcggaagatggcagcccagattattggcaacatgtactccctgacagaccagaaggacttggctccgtacctgcccagcgtgacgcctggcctgaaagcatcgcttttggaccctgtgcctgaggtgcggaccgtatctgcaaaggcccttggggccatggtgaagggcatgggggagtcgtgctttgaggacttgctgccgtggctgatggagacactgacctatgagcagagctctgtggatcgctcaggcgctgcacaggggttggctgaggtcatggccggtttgggggtggagaagttggagaagttgatgccagaaatcgtggctacagccagcaaagtggacattgcaccccatgtccgagatggctacattatgatgtttaactacctgcccatcacctttggagacaagtttactccttatgtggggcccatcatcccctgtatcctcaaagctcttgctgatgagaatgagtttgtgcgtgacaccgccctgcgcgcgggccagcgggttatctccatgtacgctgagacagccatcgccctgctgctgccccagctagagcaaggcctctttgatgacctttggagaatcaggttcagctctgttcagctccttggggatctcctgtttcacatctcaggagtcactgggaagatgaccacagaaactgcctctgaggatgataactttggaactgcccagtccaacaaggcgatcatcactgccctgggggtagagcggcggaaccgggtgttggcagggctgtacatgggccgctcagacacccagctggtggtgcggcaggcgtccctgcatgtctggaagattgttgtctccaataccccccgcaccttgcgtgagatcctacccactctctttgggctcctgctgggtttcctggccagcacgtgtgcagataagagaacgattgcagcgagaacattgggagatcttgtgcggaagttaggggagaaaatcctccccgagatcatccccatccttgaggaaggcctgaggtctcagaagagcgatgagaggcagggtgtgtgcattggcctaagtgagatcatgaagtccaccagccgggatgccgtgctgtatttctctgaatccctcgtgcccacggcaaggaaggcttngtgtgacccactggaggaggtcagagaggcggcagccaagactttcgagcagctgcattccaccatcggccaccaggctctggaggacattctcccatttttactaaagcagctggatgacgaggaggtgtcagagtttgccttggatggtctgaagcaagtcatggctattaagagtcgtgtggtgctgccctaccttgtgcccaagctgacaacgccacctgtcaacacccgggtgctggctttcctttcgtcagtggctggtgatgccctcacccgtcatcttggcgtgatcctcccagcggtcatgctggccctgaaggaaaagcttgggaccccagatgagcagctggagatggccaattgtcaggctgtgatcctctccgtagaggatgacacagggcaccggatcatcatcgaggatctgctggaggccacccgcagccctgaggtgggcatgaggcaagctgctgccatcatcctcaacatctactgttcccgctcaaaggctgactacaccagccacctgcggagcctggtctcgggcctgatccgcctcttcaatgactccagccctgtggttctggaggagagctgggatgccctaaatgccatcactaagaagctggatgctggcaaccagttggcactcattgaagagctgcacaaggaaatccggctcatagggaacgagagcaaaggcgagcatgtgccaggattctgcctcccgaagaagggagtgacctccatccttccagtgttgcgggaaggagtcctgactggcagccctgagcagaaggaggaggcagccaaagccttaggcttggtaatccgcctgacctcggctgacgccctgaggccctccgtggtcagcatcactggccctctgatccgcatcctgggggacaggttcagctggaatgtgaaggcggctctgctcgagacactcagcctcttgttggctaaggttgggattgccctgaagcccttcctgccccagctgcagaccactttcaccaaagccctgcaggactccaaccggggggtgcgcctgaaggccgcagatgctctggggaagctcatttccatccacattaaggtggaccccctcttcacagagctgctcaatggcatccgcgccatggaggacccaggtgtcagggacaccatgctgcaggccctgaggtttgtgattcagggagcaggggccaaagtggatgccgtcatccggaaaaacatcgtctcactcctgctgagcatgctgggacacgatgaggacaacactcgcatctcctcagccgggtgcctaggggaactgtgtgcctttttgactgaagaggagcttagtgccgttctacagcagtgcttgctggcggacgtgtccggcattgactggatggttcggcacgggcggagcctggcactttccgtggctgtgaatgtggctcctggcagactttgtgccggcagatatagcagtgatgttcaggaaatgatcctgagcagtgccacggcggacaggatccccattgcggtgagcggggtccggggcatgggctttctcatgagacaccacatcgagacaggcggagggcagttgccggccaaactttccagcctgttcgttaagtgtctgcagaacccatccagcgacatcaggctggtggctgagaagatgatctggtgggcaaataaggacccactgcctcccctggacccccaggccatcaagcccatcctgaaggctcttcttgacaacaccaaggataagaacaccgtggtcagggcctacagcgaccaggcaattgtcaacctcctcaagatgcggcagggtgaagaggtgtttcagtccctctccaagatcctggatgtggccagtttggaggtgctgaacgaggttaaccgaaggtcccntgaagaagctggccagccaggccgactccacggagcaggtggacgacaccatcctgacatgagaggcctgggcnagcagcagcattgccgctccacatctttgctcaatgttttcatttttgaaaatacatttgttccaatggggagcttggaagatggcgttcccagaaagtattttaatatcaatagaccacagccaaagccttaaatcaaacccacacacaactgaaaattgcctcctccatctctcaccttttcctgtggagaagagaaggaaaagcacacgcatgcgcctcagcaaatggcagcccaggagctgtttgtccagtttagcatggctaggtctggaactataatagcagggtcagactgtgggttcctcttctcctgtgcttgagctctggtttgagagctggcgctaccaacctttttcctatatcccgagtggggcacagacggtggatctctgcccagtgtggtgtgtctggcttggcttttcaatattgtgaggtctgaatggatctganccctgtcagatgaaaatgattcacagctctggcagttcccaagtctggggaggggtataggtttgaaaggctgtttgaaagaggaatgtttaataaaggctttgatttaatcttgananaaaaaaaaaaaaaaaaaactcgagggggggcccggtacccaattcgccctatagtgagtcgtt

SEQ ID NO: 444 - DNA, 3576 bp, Homo sapiens
  modified_base (3)..(3): a, c, g, or t
  modified_base (24)..(24): a, c, g, or t
  modified_base (1533)..(1533): a, c, g, or t
  modified_base (1631)..(1631): a, c, g, or t
  modified_base (2679)..(2679): a, c, g, or t
  modified_base (2713)..(2713): a, c, g, or t
  modified_base (3419)..(3419): a, c, g, or t
ttnttttttttttttttttttttnaaaatttgaacaagtatttatttcttaaaatttacttaagggattagagctaatatataatagaacatttaatataacatttggagttatgtcaacataaaaatagctgtggttacaattagcacatgcaattcactgcaaaggtaaaaatacatgctatactctagacaagccttccaaatgaagttagagtagatggggtaaaacagcaagtgaacatgaaaggattgcacttagaagaaagtgggacatagctaggatataaaagaaacatacctaatgctagtcagtcactgcattgtcctactagcaaattgcacatttatttttagagtatattcaatacacatacatattgagactagagaattttcaaatatctacctttgaaatatccctttgtttctaacacatcacattatggtattaatgtaacagcacttaaaacctgtagttatcattcaaagcttgtgttcaagagataaaagaacatcattcagacaaagcctgtgttcaagaaataaaaaaaacatctatcactatcggccttaaatgcatctcatcacacgacccatcaactttaatgaaatgggtaatgaagttaaactaaccagtttgtacaaactattgactgagaaaaagcccttaaaaatttaggaacaaatgagcaacagaagagctcaccctgagctgccaccttttaatttttaatgcaatgtatatgagaatatcatgctaatgcacatactagtagcatgtatgatggaaaaaaataggttaatgcaaaagataatacgcttggctttgtaaagttttgttttgacttacatcatctgaattctgtttatcgagtctgaaaaggaactgctgccaaggaccagtccaaagaagaattaggctgtaagactgctagttcataccttctttgaaatcaatgacaatgtccaattttaggctaatcctaaaacacttgccattttatgactccatattcttttaatttacagaaaagtacaaattttttagaaagtaatcttatcagcacaatataatctaacaatacctgtaatagaaagctatcccagtaaattttttttgaacaattgaacttttgtcttatgcagcttataactttgttattttattcatctcaacaaaataaaactttattgaaacaaaagtgtatggtttaggaatatgctcttaataacaactgagcaaaattagaatgatgtggactataacagaatgaaggaagatctctcctgcttgatgtacttggtcaatatatgttagtaaacagaaatattttagggaattctatgattattctacttctacatttacatgtcatggttttaactagttaaatgggtagaaaaaagacatctttaataattgatttctatttctcaaactagatgctctactttaaatatgagctttaatgaatgttttgtaacattttaaagttgtaacatttctaagtatactccactaacttcacantaagagctagggtcactggatgacttcatgtggtaaaatcccttatcaaggaataaggctgaaatttaaatgaacaattaggtagagaagaggtatgnacacagaacatgtgaatgaaatttgctttttttccttgctgctgttcccgagtgccgactgatccatagtaaaaaaggacaagattaaaattttaggttttaatggtacaaagtgtgaagttttatagttttctaataattattcagtattatccctttcagagatgagggtaggataccacagacatcagtaactgacaagttataatatcaacacatgtaacatttgggtcattattttataaccctaaagggagcaactgcaggtgcagaagcagtgagtgaactagttttgtccagacaaggttttctgatgtgctattactttaaacaccacttttggacactaaagatttaaagtgataaagccactaactaactttattagactagtttttacataaataaccagatttctttgcctacctaaagtacaatttacatgcatcaacacatagattattctaagacatgcttgggaaagtaattttgaatgtaaaaagttttataatttattttctccttagggcaggtgtacattacatattagtgctcaaatatatgttcatttccagaatgaatttttgcacagtaatcatatatccatttaatatgtataaagtgttcttggggatgggggtatattcactcactgtaccatgttttatacaggcttcaacatgcaaatttgtttatatcatggccttcaatgatcctccattctcattcctgtagattaagagttcatattgtatatctgaccctgaaatgtacaaacttcacactacaacattcttcatgacactatttgttatgaggaaagttgcagctaaatattagtcatgtgacttaaattttgagaaaatggaaaatgtaataggtataaatttcctgacacatacagcaagacaaatccagcccagcctttgatgatcaacttaaaagctggagatgtcattatcttgttgtgtaaatttgggtctatccctacctttacttctctgtgcctgattttcctcatctactttgaattcgtcattctattaantctacttttgcctaaagtgggaaactgaatatantcagaatgaaacatctatttttttcataaagaagatcatataatatgtgaaagaactttgaaaggatgaggcattatataaatgcaagaatataaaagataaacaggaagtctaatgtgaacaatattctgagagtaaaaagtgtaattatatttccattgtaaatgtataccaagttttcttagctttctattctccaataacctctagaaactattctaagcatgcctggtttctgtaacttaaatatggcataaaaacctgtttcctttgaattcacttgatagcagtagtcaatcactaataacgcttgctaatttcctcttactttctaagaaaacccctatatttagcatctgcttccatatcgcacgtggtggttaggggacagcataagtacactagcggctttagcactaaactcgaggcctgggtcacttctcccttgaagaaaaaaggttttaaaaattcctaaatcacaatgtagaactaagttccaccctacctcagaactgcagacattaaaataccatctctttattaagtgtctctacaataatgatatttgctaagaacaagatgtacattttttggggttctgttttgttttggcaaatattgcccaagttgtcttagtgtgcctcaaacatttactaaaaataaaaaaatttaaatctttgcctacttatttaaaaataaaaaaaantactcaaaacaaatttaagctgaagatatatactgtataaagtgttcatctacccagtactctgaagtcttaagaaaagtcaatgatatgtgtgtgtatatgtgtgtgtatatatatatatatatatacacacattagcaatttaagccttttaaca

SEQ ID NO: 445 - DNA, 3576 bp, Homo sapiens; identical to SEQ ID NO: 444
  modified_base (3)..(3): a, c, g, or t
  modified_base (24)..(24): a, c, g, or t
  modified_base (1533)..(1533): a, c, g, or t
  modified_base (1631)..(1631): a, c, g, or t
  modified_base (2679)..(2679): a, c, g, or t
  modified_base (2713)..(2713): a, c, g, or t
  modified_base (3419)..(3419): a, c, g, or t

SEQ ID NO: 446 - DNA, 2911 bp, Homo sapiens
  modified_base (50)..(50): a, c, g, or t
  modified_base (63)..(63): a, c, g, or t
  modified_base (79)..(79): a, c, g, or t
  modified_base (99)..(99): a, c, g, or t
  modified_base (111)..(111): a, c, g, or t
  modified_base (129)..(129): a, c, g, or t
  modified_base (214)..(221): a, c, g, or t
  modified_base (817)..(817): a, c, g, or t
  modified_base (831)..(831): a, c, g, or t
  modified_base (957)..(957): a, c, g, or t
  modified_base (1074)..(1074): a, c, g, or t
  modified_base (1208)..(1208): a, c, g, or t
  modified_base (1227)..(1227): a, c, g, or t
  modified_base (1698)..(1698): a, c, g, or t
  modified_base (1700)..(1700): a, c, g, or t
  modified_base (1765)..(1815): a, c, g, or t
  modified_base (2252)..(2252): a, c, g, or t
  modified_base (2254)..(2254): a, c, g, or t
  modified_base (2264)..(2264): a, c, g, or t
  modified_base (2300)..(2300): a, c, g, or t
  modified_base (2708)..(2708): a, c, g, or t
  modified_base (2715)..(2715): a, c, g, or t
  modified_base (2720)..(2720): a, c, g, or t
  modified_base (2728)..(2728): a, c, g, or t
  modified_base (2738)..(2738): a, c, g, or t
  modified_base (2752)..(2752): a, c, g, or t
  modified_base (2784)..(2784): a, c, g, or t
  modified_base (2828)..(2831): a, c, g, or t
  modified_base (2853)..(2854): a, c, g, or t
  modified_base (2856)..(2861): a, c, g, or t
tttttttttttttttttttttttttttttttttttttttttttttttttntgctatgcaaggntttatttacaacttanatgactctatgattgctcanaatctgacacanactaataagtttcattgnctgaaaatactcataaaatacctcatctccaaaataattcaaatacataattaaatgaacgtttttaaaatgagagttttcagannnnnnnntttttttttttttagtaaatatatgttttatttgtcaagagtaaatgtcagttttatttagaatattcaagtacaaaaaatgaaaatgtatatatctatgactgttaagaaatgttagaaatcattaaaatgttctgagaataccagtaaggcactgaatgcaaataccacctgaaatatgaattatgtgcatttttatatctttaatattcagatgttcatagttattttcttaaaaagtatttttaataaaatgattcaaccttattatttttaccctggaagacagagtttaaacaagtatgtaatgaaaagttttcctaatgaaagctgtgatacactcatgctcaaaggtactttatccttaggaaaaaatagcttatatatctggatgttttaacttttaaagatattttgtttcaccacagtaatacgtcagccataataaggcataataaagcatgaagtcatcatattaaataatctgacacaaaagcttaagatcatatcaccaattgggtaattgtataaaaaatttttaagttctataaaactattaagaggttagagttttagctccataatacatcccaaancatattccccaaantttttagcatatataaaaaaggttcatcttggaatataaatgtaatcagatagccacgatattaatgggttctgtattttcagtggcactgacttcgctctttggtataatgcactgcagtgacantagcttggtagcaagagaaaagatttagattcatcacagaacagcaacttaaacatttctaacaacagtgaatatatatgaatatataggtacaagctgagtatcccttatccaaantgctagggaccagaagtgttttggatttcaggtttggaatatctgcatatacacaacgggacccgactctaattacataattcatgtttcacatccaccttatacatatagcctgaaagtaatttatacaaaanttttgtgcaagaaacaaantctgtttaaactgaaccatcagaaagcaaaggtgtcgggtggggaattttccacttgtggggtcaagtcagtgctcaaaaagattcagattttgaagcttctggatttcagatttttgaattagagatgctcaacttgtagtatcattcactctggcttatgtattgaccttgtacttgaaagtacttttccataaatatcagtaactgtggctgttcaccaaatatagaagtgataaaacaaataacagcaaaatcaaagcacacttctagtttttttttaataaagtttgcttgtgatgatgaccttctgtgctctggaacttctgttttacaaaaaattggagttcttacggtccttgtccttcctcaggttgctgcctgttgccagaaaggactggctgtgaaatatctcggaggtagctttctttttagagaaagcaattatttcttcttccaaaagtcttctctntntcttcaagcttcattctctcttcttggtgaagtctcttaaggtgctcaaatttggcctgtagctnnnnnnnnnnnnnnnnnnnnnnnnnnnnnnnnnnnnnnnnnnnnnnnnnnngactggcttgttttctgggcccacatctgtaaagcccatttcctccagtttgcagcgcctgtaaagctcatagtgcctggtatgggtctgctctcgcaggtcctccatatttgtacaaatgagcatttcccgcagctttacaaagtcacagtggttttcattttccacttgtacaacaccccaagggtactggcgagctttgaccatcttgtttccgacttttacctcatccatacttcccacaacagcaaacggcaactgtccattcattgcagcgttgaccttagcaatagtgtcatcatccgttgggaactggtatatctggacgccattgctgaccaattcactcatgagcttgatcttaaacttctgtaattcagttttagaaaccgtatctgctttggcaatcactggtataatgtttaccttgctgtcangnttcttcatgnttaagagatcaagtgtcttcagagagtggcctgtcngtgaaatgaagtagaggcacacacggatgcgagaatcagggtaggtaaagagagaacgtttaatcttcagttattcttggagacaggcctcaaactgagcatctatgtagtcaactatcggttggtagctctcttctttatttatttggtcaccaaatcccactgtattcacaatggtcaatttcaatcgaacattactttcctggagttcatatgtctgaactttaagtttaacatttgggcaaaatgtgaggattcatagtcttccaattagtattaaacatgtgtcaatcagtgttgattttccattccagtttcccccacacagaatattaaagcagaaaccttgctgaacggatctgttcaccagctgatcaggcaaattctcaaaccaacatggccagacanagtcaangaacngaatgttntctctttttntctgttcatcatcngatccttgtgaagacatacaagttgttttcgntgccatgtgagactgaaagagcaggtgccgcgccacctcggagnnnnccatggtcgcgggcaggggcanngnnnnnngcggctgtatcaggcccggccccgagcggctggtcccggcgacggcggcg

SEQ ID NO: 447 - DNA, 2762 bp, Homo sapiens
  modified_base (89)..(90): a, c, g, or t
  modified_base (459)..(459): a, c, g, or t
  modified_base (488)..(488): a, c, g, or t
  modified_base (508)..(508): a, c, g, or t
  modified_base (631)..(631): a, c, g, or t
  modified_base (670)..(670): a, c, g, or t
  modified_base (782)..(782): a, c, g, or t
  modified_base (867)..(867): a, c, g, or t
  modified_base (923)..(923): a, c, g, or t
  modified_base (942)..(942): a, c, g, or t
  modified_base (981)..(981): a, c, g, or t
  modified_base (988)..(988): a, c, g, or t
  modified_base (993)..(993): a, c, g, or t
  modified_base (1010)..(1010): a, c, g, or t
  modified_base (1078)..(1078): a, c, g, or t
  modified_base (1883)..(1883): a, c, g, or t
  modified_base (1896)..(1896): a, c, g, or t
  modified_base (2049)..(2049): a, c, g, or t
  modified_base (2545)..(2545): a, c, g, or t
  modified_base (2651)..(2652): a, c, g, or t
  modified_base (2697)..(2697): a, c, g, or t
  modified_base (2700)..(2700): a, c, g, or t
  modified_base (2702)..(2702): a, c, g, or t
  modified_base (2704)..(2704): a, c, g, or t
ggtgggtgcctgccagcagctgaggcgccatggcggcggcagcggtgtcagagtcttggccggagctggagctggctgagcgcgagcgnncggcgggagctgctgctgacggggcccgggctggaggagcgagtgcgggcggcgggtgggcagctgccgccgcggcttttcaccctgccgctgctgcactacttggaagtgagcggctgcgggagcttgcgcgcgccggggcctggcctggcgcagggcctgccgcagctgcacagcctcgtgctgcggcgcaacgcgctggggcccggcctgagccccgagctcgggccgctgcctgcccttcgggtgctcgacctgtcgggcaacgcgctggaggcgctgccgccgggccaaggcctgggccccgccgagccgccgggccttccgcagctgcagagcctcaacctcagcggcaaccggctgcgcganctgccagccgacctggcgcgctgcgcccngcgcctgcagagcctcaacntcaccggcaattgcctagactcctttcccgccgagctctttcgccccggcgcgctgcccctgctcagtgaactggcggctgctgacaactgcctccgagaactcagccccgacatcgcccacntggcctcgctcaagacgttggacctctcgaacaaccagntgagcgagatccctgcagagcttgcggactgccccaagctcaaggagatcaatttccgtgggaacaagctgagggacaagcgcctggagaagatggtcagcggctgccagancagatccatcctggagtacctgcgcgtcggaggccgtggtggcgggaagggcaagggccgtgccgagggctcggagaaggaaganagccggaggaagaggagggagaggaagcagaggcgggaaggtggtgatggggaggngcaggacgtgggagatgcnggccggctgctgctcagggtcctgcacgtctctgaaaancccgtanctctngacagtcagagtgagcnccgaggtccgggatgtgcggccctacattgtgggggccgtggtgcgaggcatggacctgcagccaggnaatgcactcaagcgcttcctcacctcgcagaccaagctccacgaagatctctgtgagaagaggacggctgccacccttgccacccacgagctccgtgccgtcaaagggcccctgctgtactgcgcccggcccccacaggacctcaagattgtccccttggggcggaaagaagccaaggccaaggagctggtgcggcagctgcagctggaggccgaggagcagaggaagcagaagaagcggcagagtgtgtcgggcctgcacagataccttcacttgctggatggaaatgaaaattacccgtgtcttgtggatgcagacggtgatgtgatttccttcccaccaataaccaacagtgagaagacaaaggttaagaaaacgacttctgatttgtttttggaagtaacaagtgccaccagtctgcagatttgcaaggatgtcatggatgccctcattctgaaaatggcagaaatgaaaaagtacactttagaaaataaagaggaaggatcactctcagatactgaagccgatgcagtctctggacaacttccagatcccacaacgaatcccagtgctggaaaggacgggccctcccttctggtggtggagcaggtccgggtggtggatctggaagggagcctgaaggtggtgtacccgtccaaggccgacctggccactgcccctccccacgtgactgtcgtgcgctgacgccagggccgcctgtccgcgtttgtttggccggttttgcggaggtttctatgcggcaatgctgaattatccgttagattttcaccccagtttttttgtnggttttttttttngagatggagtctcgctctgtcgccaggctggagtgcagtggcgtgatctcgagtcactgcagcctgtgtctcctgggttcaagcgattctcctgcctcagcctcccaagtagctgggactacaggtgtgtgccactaagctcagctaattttngtatttttagtagagacggggtttcaccattttgaccaggatggtcttgatctcttgacctcatgatctgtccacctctgcccctcaaagtgctgggattacgtgatccacccgcctcagcctcccaaagtgctgggattacaggcgtgagctgtgcctggcccaccccagcattttttaagatgtatgtattcgttgttctgtttttccagatgattctgtcgtaaagtgatgctatgttgtcgttacaacatcaaagtgattttacggtttttgatgggattattcaagtgtcagaattaactgttcaaaatgttctgaatcatgtagatacatggcaggtaactgtttatgggagaaaagtacagtgctgttacgtggcactgtacagtcatgtgccacgtaacagcgtctgggtcagtgacggacacttacctgacagcggatccacaatattctcgtgcagtgtgtttggaatcctggtctgggctctcgncgttggccttgtagatcaagtaggggaagtgagtgatgttcagtcatgctgctgggacacttggttttccagatgaaaacacataaataaaactacatgcaccatnnaaaaaaaaaaaaaaaaaaaaaaaaaaaaaaaaaaaaaaaaaaaanagngngngagagaagaaaaaaaaaaaaaaaaaaagaggaaaaaaaaaaaaagaaaaaaaaaaaaa

SEQ ID NO: 448 - DNA, 1632 bp, Homo sapiens
  modified_base (6)..(11): a, c, g, or t
  modified_base (13)..(15): a, c, g, or t
  modified_base (51)..(51): a, c, g, or t
  modified_base (731)..(731): a, c, g, or t
  modified_base (1600)..(1602): a, c, g, or t
gaccannnnnncnnnggggctggcgggcggcggggtccgcggggccgcagnagatgacggccggcggcaggccgaggccgagggcgctggcggggagcccggcgcggcgcggctgccctcgcgggtggcccggctgctgtcggcgctcttctacgggacctgctccttcctcatcgtgcttgtcaacaaggcgctgctgaccacctacggtttcccgtcaccaattttccttggaattggacagatggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagcctaccgatgttcaccgtgctcaggaaattcaccattccacttaccttacttctggaaaccatcatacttgggaagcagtattcactcaacatcatcctcagtgtctttgccattattctcggggctttcatagcagctgggtctgaccttgcttttaacttagaaggctatatttttgtattcctgaatgatatcttcacagcagcaaatggagtttataccaaacagaaaatggacccaaaggagctagggaaatacggagtacttttctacaatgcctgcttcatgattatcccaactcttattattagtgtctccactggagacctgncaacaggctactgaattcaaccaatggaagaatgttgtgtttatcctacagtttcttctttcctgttttttggggtttctgctgatgtactccacggttctgtgcagctattacaattcagccctgacgacagcagtggttggagccatcaagaatgtatccgttgcctacattgggatattaatcggtggagactacattttctctttgttaaactttgtagggttaaatatttgcatggcagggggcttgagatattcctttttaacactgagcagccagttaaaacctaaacctgtgggtgaagaaaacatctgtttggatttgaagagctaaagagtctgcagcaggattggagactgacttgtgactgcgggctgggggggcattcccagtaggaatgtgaagccagaggtttcggattcgtgacatccaccccctgggcaagtgagagcatctgcaaaatgcaaagagaactacctcatatgcaggatgagccaatggcagtctcaagaaatgtactcgggcgacaccttacctgtggaaagcaaatcttttcaaaataagccactgggactcggtaggtggagccccagctgctcttctagggacctatggggccttcgtggcatctctgtgctgtgtgctggggaggaggttgatgtaatggtgactcttttctgatcagcaccttggccgtgattcccaaggtcccagccaaagcaaagggccagttgtttcagtttaaacagacatgtctttagtctaataaaattagttaactgccagtaaagttatttgttagctttgatgaaagctatgttggtatctttccctaatcatcaaagtaaataaaaaatcatttctannnaaaaaaaaaaaaaaaaaaagggcggccgct

SEQ ID NO: 449 - DNA, 1829 bp, Homo sapiens
  modified_base (94)..(94): a, c, g, or t
  modified_base (161)..(161): a, c, g, or t
  modified_base (221)..(227): a, c, g, or t
  modified_base (962)..(962): a, c, g, or t
  modified_base (970)..(970): a, c, g, or t
  modified_base (981)..(981): a, c, g, or t
  modified_base (1006)..(1006): a, c, g, or t
  modified_base (1027)..(1027): a, c, g, or t
  modified_base (1077)..(1079): a, c, g, or t
  modified_base (1081)..(1082): a, c, g, or t
  modified_base (1086)..(1097): a, c, g, or t
  modified_base (1104)..(1105): a, c, g, or t
  modified_base (1108)..(1108): a, c, g, or t
  modified_base (1613)..(1613): a, c, g, or t
  modified_base (1761)..(1761): a, c, g, or t
ttaaatgctctttgccagatattctcctgcagctctaaggaaaggaaatcaatttaaaaataatttgtagaatctactattgagccaccaaagnataattccctaaaagtttaagaaaccctggcaattaattcagcataaacatatcctataaacagcangagaggttcagctttctgattttactgtggaccttttcctaagggcattcatgaatgcannnnnnnttttaactatggcttacatttattttaaatttcactaaatacaaatcttgattgtcatgccagttttagatcttattaattttcagaatggataaattcaaataatcataaattacggtaactttttattataccaaggtgttctaatgccatcatatgaagacagatgcttcaaacaacctgcattaaattatatttttaataaaattaaaatctatttttaacctatttgtagtcacaaaccgaaaacgtgtcgtctttaccttagagctaaaggcttactttatgcatacggtatatttaatagtctacaaatcaaagatttaaacagtcccttaaaaattccatatattctcataccaactcatctacatagaaatgaaaatctctattgttctcacaaaccattaccatgagttcactataacaactggatcaatatggcttgcctttcaaagttaaagaatcagaaaggggcctgtaagaagtcatttagcccaattccctcaccctgtgtgttttccctcaaagccagtgcaatttttttttaaccaaaaaactggacatgtttaatacatacagtttgacaaatttggatttcactctttgttttgatgtagtaactcttttataaaagggaacagattcagacaagctcagtggcccaactgaagacattcagcaattaatggcaggacttcagtaatcagtggcaggactacaacatacatctcnttcatgcntagggaaaccnaggctctctattataaagctgaccnagggctattgttttccccttntctctcatcctaaacaccattcatatttttcctaggtcacattttagtgnnntnntttnnnnnnnnnnnnttttttnnttntcatgttttaccttttttattgaattatatacacctcttacaaaaatgcttgaagtaatttaacacctgtacatcagtacaaaacctggctgagtaaaatgaagagaggatctattcaagatcattaagaccaaatgtaaactgggaagtatgtggaagatagctgtccagcaagtgtctggaaggtgttctagctgggtagagagcctattctaacagacacgcacatcgcagaaagcagcatgaacagaaccacatcctagataagagttctgtgtacagaagatccatggaggcaagtgctgtcaggaaggacactgcctccctccaccctcccaaatgtcaccaccaagttccttcaggtgagacctcacacaatgtcaagtgctttctaggaaatactaagatcaggttgagagattctgcttggtctagtcaatctgaaaaattcaggctggaaagacaccttttctcaagagctgaattgacttttgccttcaaatcntgcctgcaccttgcctacgatggcatcaatttacacctaaggacctttgaagagaaaaattccattatttcttttctttcttgagagcagattttttccctcctcctttggaagatttgcagtactttgcttccatctgagccagaanattgtccatttccttttgccgatccttttgtctgctctgtttgagaagttaaaacacaagctttcaaa

SEQ ID NO: 450 - DNA, 1531 bp, Homo sapiens
  modified_base (259)..(259): a, c, g, or t
  modified_base (261)..(261): a, c, g, or t
  modified_base (263)..(263): a, c, g, or t
  modified_base (265)..(278): a, c, g, or t
  modified_base (280)..(280): a, c, g, or t
  modified_base (797)..(797): a, c, g, or t
  modified_base (1155)..(1155): a, c, g, or t
  modified_base (1165)..(1165): a, c, g, or t
  modified_base (1170)..(1170): a, c, g, or t
  modified_base (1184)..(1186): a, c, g, or t
  modified_base (1189)..(1195): a, c, g, or t
  modified_base (1198)..(1200): a, c, g, or t
  modified_base (1220)..(1221): a, c, g, or t
  modified_base (1223)..(1223): a, c, g, or t
  modified_base (1225)..(1226): a, c, g, or t
  modified_base (1228)..(1231): a, c, g, or t
  modified_base (1234)..(1236): a, c, g, or t
  modified_base (1238)..(1241): a, c, g, or t
  modified_base (1243)..(1244): a, c, g, or t
  modified_base (1246)..(1246): a, c, g, or t
  modified_base (1249)..(1249): a, c, g, or t
ttttaagcgacacctttccttttattagattcacaatgcctttgtaactttaaccactcctttgtagaatttttctttgttagaaaacagacaaactctgtccttaggaaccgtcttctacttggtacagcactgcctcagccgcctgcatcgcgtgaccagtaagaatgaagtccagcagcatagagaaaagattcataaaggctgggaggtcatcccccagggcctcccctacttcacatacacagagacgtgtgcntntntnnnnnnnnnnnnnntnttatatatagatatgtatttttttttttttttacaaaaataacagggtttgcacagctctattaattttttaaaattacacaggcaaggtttatgcttcagtataaccatttttactttggatttaagtgggaattttaggcctaaaaataagattaccaagcagaggccatctagccacacagacacaagacatcttgagctccatgaaactagaaatgtggtgatgtcatcctcacacgggggggctacacatccccatcgattattttaactaaaatacaaaagcaaaatagtgtgttaaaataatcctctactcaatgcattagcacatataccaaattatactatctgcatgacagtctctaggtaccaagactgtatttttgcaagtgctattctctacttcattaaatacagtacccagccagcaaccacaaaaagagaacgcatgctgtacagcaagagaaggggagggagacgattttcagggccataacttccatggcaaccaaaanaaaaataagtaagacaaatctcacatgacagatataaaactaatttgcagtgacatttgatatatagttttatcagaagtaatacatttaggttacagttacatgaaaaagagaaactatgtgaaattataggctttctcctagaatatccaaaatgctcatcaacagttaattagtacaagaaagatgaccaccaggtgattgaatagacagaatgtcatgtagtattttaaaaacacagattctgggactagaagctaccaccaaaatatccagaaatctgagttaacaggtcctttattttgcacacttgctgctgatatatagaaccacgaagtgtttgcacagaccacgaatncagccgctancctanaggctggtcacagnnnagnnnnnnntgnnnaccgtcctgccagtgtgagnncngnntnnnngannngnnnntnncnccncggtcggattctggaggagggaggcatcttggcctgcagtaagcggtgctgacgggactctggccacagaggtcaggcctcctgaaaacagcactgccttccgcgctgccccagcttgccccattccttgtccgccaacccaccgtgattcatcttctgaagctgggagtgaaactgggtcagctgtaacctgttcctattcatctggaaggagggaggcttggatgagcaggggatgagagctgcagggaaataaatgagatattcgtccttaaaaaaaag

SEQ ID NO: 451 - DNA, 1844 bp, Homo sapiens; identical to SEQ ID NO: 203
  modified_base (13)..(15): a, c, g, or t
  modified_base (51)..(51): a, c, g, or t
  modified_base (58)..(58): a, c, g, or t
  modified_base (60)..(61): a, c, g, or t
  modified_base (63)..(63): a, c, g, or t
  modified_base (72)..(74): a, c, g, or t
  modified_base (78)..(78): a, c, g, or t
  modified_base (87)..(90): a, c, g, or t
  modified_base (93)..(93): a, c, g, or t
  modified_base (95)..(95): a, c, g, or t
  modified_base (390)..(390): a, c, g, or t
  modified_base (415)..(415): a, c, g, or t
  modified_base (1024)..(1025): a, c, g, or t
  modified_base (1035)..(1036): a, c, g, or t
  modified_base (1039)..(1039): a, c, g, or t
  modified_base (1048)..(1050): a, c, g, or t
  modified_base (1054)..(1055): a, c, g, or t
  modified_base (1293)..(1293): a, c, g, or t
  modified_base (1320)..(1320): a, c, g, or t
  modified_base (1326)..(1326): a, c, g, or t
  modified_base (1372)..(1372): a, c, g, or t
  modified_base (1380)..(1380): a, c, g, or t
  modified_base (1386)..(1386): a, c, g, or t
  modified_base (1466)..(1466): a, c, g, or t

SEQ ID NO: 452 - DNA, 2093 bp, Homo sapiens
  modified_base (42)..(42): a, c, g, or t
  modified_base (47)..(47): a, c, g, or t
  modified_base (54)..(54): a, c, g, or t
  modified_base (59)..(59): a, c, g, or t
  modified_base (61)..(61): a, c, g, or t
  modified_base (63)..(63): a, c, g, or t
  modified_base (69)..(69): a, c, g, or t
  modified_base (71)..(71): a, c, g, or t
  modified_base (84)..(84): a, c, g, or t
  modified_base (89)..(89): a, c, g, or t
  modified_base (92)..(92): a, c, g, or t
  modified_base (100)..(100): a, c, g, or t
  modified_base (107)..(107): a, c, g, or t
  modified_base (112)..(112): a, c, g, or t
  modified_base (115)..(115): a, c, g, or t
  modified_base (118)..(118): a, c, g, or t
  modified_base (121)..(121): a, c, g, or t
  modified_base (124)..(124): a, c, g, or t
  modified_base (127)..(127): a, c, g, or t
  modified_base (133)..(133): a, c, g, or t
  modified_base (137)..(137): a, c, g, or t
  modified_base (140)..(140): a, c, g, or t
  modified_base (144)..(144): a, c, g, or t
  modified_base (150)..(150): a, c, g, or t
  modified_base (156)..(156): a, c, g, or t
  modified_base (162)..(162): a, c, g, or t
  modified_base (165)..(165): a, c, g, or t
  modified_base (169)..(169): a, c, g, or t
  modified_base (174)..(174): a, c, g, or t
  modified_base (181)..(181): a, c, g, or t
  modified_base (200)..(200): a, c, g, or t
  modified_base (207)..(207): a, c, g, or t
  modified_base (235)..(235): a, c, g, or t
  modified_base (247)..(247): a, c, g, or t
  modified_base (253)..(253): a, c, g, or t
  modified_base (274)..(274): a, c, g, or t
  modified_base (279)..(279): a, c, g, or t
  modified_base (281)..(281): a, c, g, or t
  modified_base (308)..(308): a, c, g, or t
  modified_base (347)..(347): a, c, g, or t
  modified_base (350)..(350): a, c, g, or t
  modified_base (387)..(387): a, c, g, or t
  modified_base (447)..(448): a, c, g, or t
  modified_base (454)..(454): a, c, g, or t
  modified_base (461)..(461): a, c, g, or t
  modified_base (467)..(467): a, c, g, or t
  modified_base (471)..(471): a, c, g, or t
  modified_base (598)..(598): a, c, g, or t
  modified_base (713)..(713): a, c, g, or t
  modified_base (732)..(732): a, c, g, or t
  modified_base (738)..(738): a, c, g, or t
  modified_base (743)..(743): a, c, g, or t
  modified_base (764)..(764): a, c, g, or t
  modified_base (766)..(766): a, c, g, or t
  modified_base (1155)..(1155): a, c, g, or t
  modified_base (1164)..(1164): a, c, g, or t
  modified_base (1170)..(1170): a, c, g, or t
  modified_base (1172)..(1173): a, c, g, or t
  modified_base (1177)..(1177): a, c, g, or t
  modified_base (1179)..(1180): a, c, g, or t
  modified_base (1417)..(1417): a, c, g, or t
  modified_base (1425)..(1425): a, c, g, or t
  modified_base (1437)..(1437): a, c, g, or t
  modified_base (1458)..(1466): a, c, g, or t
  modified_base (1468)..(1468): a, c, g, or t
  modified_base (1470)..(1471): a, c, g, or t
  modified_base (1743)..(1758): a, c, g, or t
  modified_base (1962)..(1962): a, c, g, or t
  modified_base (1966)..(1971): a, c, g, or t
  modified_base (1973)..(1976): a, c, g, or t
  modified_base (1980)..(1984): a, c, g, or t
  modified_base (1987)..(1987): a, c, g, or t
  modified_base (1990)..(1990): a, c, g, or t
  modified_base (1992)..(1993): a, c, g, or t
cccacgcgtccgcccacgcgtccggacagacctaatgctctnattanagttcancctgncnancagaanancagttcatcattnccccntgncatattcnttttccntgctngcntantcncangangaaatncagnccntcangcgccnctgaanagcttnccntttntccgnagcaggntgtcagggcagaaaccaancaaaggntcatgcttcaccccttcctccatctgcntgcacctaccanctgatntctacagattccataacaggnacagnanattcaagacagagagaagaagagctgnaattaatagaccaactgcgtaaacatattgagtaccggntgnaaagtgtctctaccttgtgatctcggagcagctctanactgacggtgttgttctttgccatttggccaatcatgtgcgacctcgatctgtcccaagnnattcantgttccnctcacncagnctgtacctaaattaacaatggcgaaatgcaggcgaaatgtggaaaatttcctagaagcttgcagaaaaattggtgtacctcaggagcaattatgtttgcctctccacattttagaagagaaaggttngagccaggttgcagtgacggtccaggctctcctggaacttgccccacccaagcaacagcagcaccagttatctgctgtttgaggatccccaggacggtgggcactggcctggccnaaacaaggaacaggacacngtgatngctgntgccagctgtctgcttaaacnangctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcnacaaccatngcacangnntttntnnttgttggagaaggagttctgctcagtcgcccaggctagagtgcagtggcataatctcggctcactgcaacctccgcctcccgggctcgggcgattctcctgcctcagcctcccgagtagctgggacagcaggtgcccgccaccagcctgaccaacatggagaaaccccgtctctactaaaaatacaaaattagctgggcgtggtggtgcatgcctgtaatcccagctactcgggagnctgaggcnaggagaattgcnttgaacccaggaggcggaggnnnnnnnnngncnngatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagatannnnnnnnnnnnnnnnagttgttaactgttctggattttctttacaatgcatccatttgggcataatgttatccctctttttatcaggtaaatgtagcatctaaaagtagctttggatcaaatcatgttgaatacctggtcaaagtaatgttttcttccttgttcttgcagagaaacaaattcatcagaacattaccacttgaccaggtttaaaattgtntaannnnnngnnnntggnnnnncangcntnnagtcccagcactttgggaggccgaggcaggaggatcacttgagcccaggggtttgagagcagcctgggcaacatagcaagaccctgtctcccaaaaatta

SEQ ID NO: 453 - DNA, 3339 bp, Homo sapiens
  modified_base (2717)..(2717): a, c, g, or t
acagtataaccgttacattttattattagttattgttgtcaatctcttaaggtgcctaattcataaacttaatcacaggtatgtatgcataggaaaaacagtatgtataaggtttgttattatctgtggttttagacatccactgggggtctggttttagatatccactgtatcccctgtggataagggggtaactgctgtatcttttagtagaagcaagagcagccccatgtgggagctaacactggacactggtcagtttcagctcctcatgcaaagtgagggtatccttgtggctccagccctggggccccctgcggtcacctttggctccacagtctggttcttgaacccaagggcagacagcttgctacagcccaggcctgaggatgcacttccttcaccaggacccacaacccctgcccatgaagacctgtggagctcagggcatcccctgatgcaggttggtcaggacctgcccagcttgcaccagcaggttctgcgtctccatctgacctggcagaccttgcactcttccacccactgtggaggactaagtgtcttgaacttccagaacacagccagggccccatacttggcctggggagaagttgggaggcctaagcagtggttgggggccacagcaaggcattgcacacagtggtttttatttctttcagggatttattaaggcattgagcacagtgtaatttctagccaagtgaaatgaatccaaggaaatatatcaggacctgagggatgtttttttaaagttactggaaaggatgatgagctgagagcacgtgtacagccacgcctgtgcgcagcgcccactctgtgcaataaacatgttctgcccatgttcctcagtcaggaggttcaggctcccggagagcacctgagggttccatcactttggtgcccaacaagcacatgcccccaacctggtgccaagaggcaggaatgacccccataccacatagctgcaggaaagcatccacggatggagggactcagctggcctggccgcagtgtggagcacagaggtatgaggcaagcaagggcagatctgagagcctgtaatgctaggcaggtgcagctggtgcgaggcgggctcccaccaggtgtaaggaaggtgggagccacagcctcttcctgggcccagaagcagccggcgccaggagatgcaggcccagggaatctgtctaaggcagctgggtctgcaccagccttctttccactcacaactcactgctcctgggagagcaggaggggcacacctttaaagagaaactgataagggaggaaaggcaggaggagatgaggccagccccactgatgacaccttgggccaggcctcacagctgcaggcatcagccggaaactccaggctgctcatggtcactggcggtgctgaactgtctctccactttcttttggtccttgatcttgagtccaatgtccactctcttctcaaagaagttcaccagcacggactccgtcaggatggaggccaggatctgctcaaaggagatgcaccagtcggtgtcgacggtgccgccgatgcgcgctgtggggctgcaggcctccccgcccaccagcaccgtgtcgtctgcaaggtcttcacattgcagggagcccgtgctgaccaccgagtaggaggacatggacatgtcgtctttggtttcatcgtcagacagcagctgggagggtgagccctgtccctcgccgctgcccccctccaccaccacctggctctcctgtggggcttttccgaggtgtgtgtctccgcctgctttggcttgggggtctcctgcagctgggggctgaagctccctggctgcgtcctgatgcagttcgggtgctggtggctcgtcctcctcagtggcacagtccctgggcttcctgcctgtgcgggctgagaacttcttccccacctctccgatgcggagcaggaggctggccacggtggcgatggcgtggtacaggtcctgctccatggggtcttcactgaacatgttgtaaagcgtcttgcacagctcaatgaactgctcctggttcatcttgggaagatccttaatcgtctccttctgagcctctttctccttggcccacattcgaaggtagtgccgatagtccggagagctggtccccttctcctctcctctctcctcacttccacttccttcttgctcttcctgtggtagtgcttcttctgaggagctgtcctctgtgaaataatgggccgcctccagggctgactcggcttcctctgggctcagagctgggggaaggtgtagcttgtagagcaccttgagcttctctgtcaggtccccgtggtacatcccgctcatccctgtcacgaactccttgaagttgatcagcgagtccttgttttcgtccaggagcctgaacatgcgccctgccagcagaggtgtgtgggagccacaggcccagggtgtcaggctggcaaagagttcccggaactggctggcatcaatccggtactgctccaggtagggcaggctggggtcccgacggccggccattgtgcggctgcacccccagtactggctagccaggtgcttggccttaaacaccatgtaaaggtcctccagctcttcaatggagaaaccaatgtccacaggtatagctcggaccacactcctcttggccgtgtcctccaaggactggatcactttcagcctctgtttaanccgcatctgctcaatgtcttcggccctcaggctgctgaatttctcataggaacactttcaggagctcaaagatgtccacctctgcaggagtagtaattcaccagcttctcgccctcaggcatcccttctgcgttccgcatcgttcagctcagcctccttgaacttcccggggtcctcgtctccactggggctgcaggttcttgttctcttcgtgcagatgattccagtgtatcgttgcccttgacgaaggtggtgatatcgtccgtcacatgtcgaagatggacagtgtctggagcaagttattttccagccattcccagtgttttgtgatctctttgcagggaagaaccacacgccactgtccagtagacactgggagtcctgggtctggtgcaggatgcaggtaagggcccacagcgggcactggagtccagcacacacgtcacagggtgcccacgagaagacccagtaaggcacagccagctccctgaccagtggccaccaggcagtcagcatgcaagcacagatagaacggggttggcccagctccgtcacccacagcgcattggccaccagcacactcactccgggctcagccacatcacggagccgctcgcaccgg

SEQ ID NO: 454 - DNA, 2738 bp, Homo sapiens
  modified_base (2453)..(2453): a, c, g, or t
ctttctacaaacaacccttcgctgacgtgattggttatgtgtatgttgcaaaactaattcctttttctacatctgattctttctacttttgtttagagttaatgctccttttatgtcacaagttgctttgctttttaaattatttcaaattggcactttgggggctgcctaagaattgataagcggggtatgatctgttgatgaatcttccagatttgtgactccctgcatcctctgatggccatttttcatatttggggttttggagggaagaaagctaactcgctttcaaaatgtgtcatttgcgatcttatctgggaacggtttgaggctcgggggaactctgctctcttgctcttggctgccatcactgctgccatgccctgttgcctgcctgcctcaggtgggaaggaggtttccccacctgggagcaggtggcagtcccaggtggttaggagccagtgagcagcagcaccttgcattgccaaaatcagagctgtggggcagcatttttccatacttggttcattcaaacaatgtggggtcgtttgcctctccctcaggcagaagagtccagagcagagggggttgtctccagtgggtgtctataattgttcctctgtggtcttgcatgtcagaaattgctatttagtggtcagcttctgatgtcctgtctcctagcacagggaagcccccagctttgagatcaggatagtcaaagtgtcttgatacgggccacttgggcttctccccctgacccccccaaaagaaacctgcatcttctctggagaaggtgtttttcttattcttttttttttctttttttcttttttcttttttttaaggatttcttttatcaaagcagtattgctgaagagttggaaacagttctcattgtctcctccttaaaaaaagggctggctttacatgagaagtaagggtggaatggaagaggagaggaacctgtggaaggtgggcgatgagctcaggtctgtagagcctctcagggcctatgaccttgagatgttcatccccttagaagatagaactgggtttcctgggcccccagatgcatttgcagtgagacttgtgaaatgctggacttacaggtggtgtttgatttgatttctgcacattctctctggagtagaaatggagactggaaaggtcgagtctggttttgctgggcagctgggtggccagcaaagccagctgcacgtccccaagcacagatagagtggcaagggcatgtccagcttactgaccatctgcattgagctcattctcattttctatatctgacttaaagtttctctcgtttcttttcttctcttcacctttaagcacaaacataaaccatccttgctacagcctagaacagttaagtaaacctttctcactgcccctaactgtgtgtgccatgaagtcgcagtgttgtagtggctctgggcttcagcggtgtttgccacggccatccctgtgatagtgccacctcagtccccacagaccagtcatctccattgcttttctttgcccgtgatgcttgttggagtagatgaatatagtgtgtcttagcgctgtcctttccggctgtagctcccaccagttaattccgaactgggggtgggctgaccttgatgtgaaagaatgttggagcagcatcctgccaaaaagcaactcacgttggctctcctgccagtgtgccctgagtggccccaaggcacctggctggagggaaaatggcaaacttttggctgaactggagaatgtcctaacaaacccccttccagaatggctttagtctctagtgcttgctagcatgggagctttgtcttgaattccttttgatctgccccgtttctctccagccttaggaataaatctagaggctattgtgcaatgatctgtgggctttttagaagtctctaaatttccttgaaattcagtacagcccagcataaactactcaagttcttgatcagcctgctgctttgttcttattaataaaagcagtgtgtagctggctaaggacttgttttattaatgctccacaggagcagagacagacagagagacatagtgagccttgaaccaaacacctgtattccaacattttacacagcggtctgggcaccctgtgcctaggagagccagctacgtgtctacctgagtctgacctgggccaggggctgttatcttgggaaagccagaatgtcattaagaaagggacaaataggcagttgcttgtgtagcaaggcagccaccaggttgctcaaagggggttctgcataaaccaacatattttgttgttgcttccagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcangtcctcatctccctcaagcaggccccgctggtgcactgaagagcaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttgcatgcctgcaggtcgactctagaggatc

SEQ ID NO: 455 - DNA, 1721 bp, Homo sapiens
agacgggctgcaagagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcaggtatcgagatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacacc

SEQ ID NO: 456 - DNA, 8592 bp, Homo sapiens
  modified_base (64)..(69): a, c, g, or t
  modified_base (72)..(72): a, c, g, or t
  modified_base (123)..(123): a, c, g, or t
  modified_base (132)..(132): a, c, g, or t
  modified_base (134)..(134): a, c, g, or t
  modified_base (425)..(425): a, c, g, or t
  modified_base (1261)..(1261): a, c, g, or t
  modified_base (1355)..(1355): a, c, g, or t
  modified_base (2679)..(2679): a, c, g, or t
  modified_base (3423)..(3423): a, c, g, or t
  modified_base (3587)..(3589): a, c, g, or t
  modified_base (3591)..(3591): a, c, g, or t
  modified_base (3594)..(3594): a, c, g, or t
  modified_base (3608)..(3608): a, c, g, or t
  modified_base (3614)..(3614): a, c, g, or t
  modified_base (3994)..(3994): a, c, g, or t
  modified_base (3996)..(3996): a, c, g, or t
  modified_base (4039)..(4039): a, c, g, or t
  modified_base (4052)..(4052): a, c, g, or t
  modified_base (4056)..(4056): a, c, g, or t
  modified_base (4116)..(4116): a, c, g, or t
  modified_base (4364)..(4364): a, c, g, or t
  modified_base (4372)..(4372): a, c, g, or t
  modified_base (4568)..(4568): a, c, g, or t
  modified_base (4784)..(4784): a, c, g, or t
  modified_base (5101)..(5101): a, c, g, or t
  modified_base (5527)..(5527): a, c, g, or t
  modified_base (5625)..(5625): a, c, g, or t
  modified_base (5766)..(5766): a, c, g, or t
  modified_base (6001)..(6001): a, c, g, or t
  modified_base (6130)..(6130): a, c, g, or t
  modified_base (6261)..(6264): a, c, g, or t
  modified_base (6267)..(6268): a, c, g, or t
  modified_base (6454)..(6454): a, c, g, or t
  modified_base (6456)..(6461): a, c, g, or t
  modified_base (6463)..(6464): a, c, g, or t
  modified_base (6467)..(6467): a, c, g, or t
  modified_base (6475)..(6475): a, c, g, or t
  modified_base (6486)..(6486): a, c, g, or t
  modified_base (6511)..(6511): a, c, g, or t
  modified_base (6563)..(6570): a, c, g, or t
  modified_base (6593)..(6594): a, c, g, or t
  modified_base (6596)..(6600): a, c, g, or t
  modified_base (6628)..(6628): a, c, g, or t
  modified_base (6644)..(6644): a, c, g, or t
  modified_base (6681)..(6682): a, c, g, or t
  modified_base (6763)..(6763): a, c, g, or t
  modified_base (6783)..(6783): a, c, g, or t
  modified_base (6986)..(6986): a, c, g, or t
  modified_base (6988)..(6989): a, c, g, or t
  modified_base (7205)..(7205): a, c, g, or t
  modified_base (7237)..(7237): a, c, g, or t
  modified_base (7712)..(7712): a, c, g, or t
aagcttgcggccgcggcggctggccggactcaggtgtttcggacgctattgcccttcgcgccannnnnncgngtgggcagcagcgggactcagccgggcgccaggttcctgccaggcagcgcngggaagcgngngcggccgagaactccttcctgctacttcgcccagcgccgctgcttcggcttcccagcgaagtgggagaccttcctccctgtttgcagacgtccgtgggagacccttattttttccaccgctaaggttaagagattctggaatagaagcgtcgaaggagatcaagtgaaccttctacaactcctcggatgtcgccagtctccctttcggggcggaagactacgtttgagcatctcactgaggtgcaggaatggaagaacccaccttgcagcttttctgcagtgtggcttgcntgatctacccctaggaatgaagaggaggcttgtaataatccgatgaagtacagatgttgaagaggatatcgcaggacctaaacttgtgatcgtttgggggaggtcacacacgtttctgagtgggaatggatgggcgtgaatgacgtgccctcttaaaaagcacaacaatcctttaagagagagcaaaattgagttttcccattttggccaagattttgaagacagttcaatgtattctacatttgacataagatgagaactttctaaagtattctctccaagagcgtaaacgatgactaccccagccctgctgcccctctctggacgtaggataccacctctgaacctggggccgccttccttcccacatcacagggctaccttgagactttctgagaagtttattcttctccttattcttagtgccttcatcactctgtgttttggggcattctttttccttccagactcttcaaaacacaaacgctttgatttgggtttagaagatgtgttaattccacatgtagatgccggtaaaggggctaaaaaccccggagtcttcctgatccatggacccgatgaacatagacacagggaagaggaagaacgtctgagaaataaaattcgagctgatcatgagaaggccttggaagaagcaaaagaaaaattaagaaagtcaagagaggaaattcgagcagaaattcagacagagaaaaataaggtagtccaagaaatgaagataaaagagaacaagccactgccaccagtccctattcccaaccttgtaggaatacgtggtggagacccagaagataatgacataagagagaaaaggnaaaaaattaaagagatgatgaaacatgcttgggataactataggacatatgggtggggacataatgaactcagacctattgcaaggaaaggacnctcccctaacatatttggaagttcacaaatgggtgctaccatagtagatgctttggataccctttatatcatgggacttcatgatgaattcctagatgggcaaagatggattgaagacaaccttgatttcagtgtgaattcagaggtgtctgtgtttgaagtcaacattcgatttattggaggcctacttgcagcatattacctatcaggagaggagatattcaagattaaagcagtgcaattggctgagaaactccttcctgcctttaacacacctactgggattccttgggcaatggtgaatttgaaaagtggagtagggcgaaactggggctgggcatctgcaggtagcagcattctggctgaatttggtacactacatatggagttcatccacctcagctacttgacaggggacctgacttactacaaaaaggttatgcacattcggaaactacttcagaaaatggatcgtccaaatggtctttatccaaattatttgaaccccagaacagggcgctggggtcagtatcatacatctgtcggtggcctgggagacagtttttatgaatacttactgaaagcatggttgatgtcagataaaacagaccatgaggcaagaaagatgtatgatgatgctattgaggctatagaaaaacatcttattaagaagtctcgtggaggtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactgcattaaagctaggtcctgaatcattcaagtttgatggtgcagtggaggctgtggctgtccggcaggctgaaaagtattatatcctccgtccagaagtaattgaaacctattggtacctatggcgattcactcacgatccaagatacaggcagtggggctgggaagcagcactggccattgaaaagtattgccgagttaatggtgggttttctggagtcaaagatgtatattcctctactcctacacatgatgatgtacagcagagcttttttcttgctgaaacattaaaatatttgtatctgctgttctccggtgatgaccttttacctttagaccactgggtgtttaatacagaggctcaccctctgcctgtgttacatttagccaacaccacactttcaggtaatcctgctgttcgatgaaagcagttccagaaggaccattctcacctgtgtttngtttacatggaccactacagaaattagtttgaaggggcggcttttgaaaacctggacctctatgtcaacatgacagggtgaaactattccccctaagactgttcaacttgtagatacatcaactttgaaattattccattttatacctgaccaaaacatgttctgatatgtgtaggacagagacctggatgtgctttgatcgttaatgaggtggtcacatgagaagtgatacctgttactactgtattgtttttagagtcctgaagtctggaggctagacttcctgaaagcaagtcaagaatatagagcaccttgcaggagttcaagatggcctttggaaccaattatgtatttgtttcctcctacagtggagcagcattcaaatcaaatatttacatattgcttatcactttttctccattttaataatggaatgaactaaaataaacaagaacaaaagaatagtataattatatcagtaacaagaagactcaaaaaagaaacaggagtacctatccctatctgaattttcaagttccccattggatgaccagactggcaaccatttcaaatcccagtctatttcattgaaatttcttggttaagtttaattttctctgggggcatgatctcacaaagaatactcaagtctttttcttcttatggaatcatcgaaactgctatttatcataatcaccacttatgagcctgggtttgggattttgtgcatgtagttcagtctantgttggtagcatgacagaaagtggggaaaatgccgcagtttgttgccttgaaacctaagagcaatccttggttttgttgctacattatttttccagaccaacacatctaccaagtaaattttattcactttaatttcataataaagttagtagagtcactcaannnanaantttatttatgtggncttggncaaaaatcactataaggcagctctaaatttgccttgataagctaaataaattacttttataacttactaaagcagaacaaacagtgaaactttctaaaatattctatctggaatagggacaggggatcttttatttataatctcatcagatgagtgagttgttcacagatattttatgtttttttaattttctccaagaatatttatagaattccaaagaatcagaatagtttcaaaataattttcagtgataaaagagtgttgtaattaatcatattacactaaaattgggatacatctaaggaactttatcttactatcagtaggttttgcattgatatttctttttaaataaactactagttctttatattttgacnanaagaacttaaattttatcaggaactgtaagataaatatctagngcttataaatttnctgnccttaaatttatgtgacagtgcaagatacttttgctcttttcatttaatataggcatctnccattgacattaataaaacttagaaacagtataattagtataacatttactctgaatttgaagatttcctgaaacaaagtttgtacaagaagcccaccttggaattctgaaggcttattttcttgtttgataagcttttcttttaaacttaggttttaagttggggaaagacttaattaactaatatagtattttctaaggttgatcatcttataccacgaatcgttaattttgacagttctactganccgtaaangataaccactgcaaattttttcagtataaaatttttcactgcaaaaaaatttcagtagaaaataaggatgcagggccagttacaatagtccttaagagagttaaattatagcacatgttttgacattgtaatatcttttactacttgaacatttaaatttctaaatgagaaaggtatatatattactgtaactgtngaagggaaaagggaaagtatttggttctaaaaaatgttagccttcctcgtaaaagtagcacaagcccacttatgaatcactgagaaaaagtgaaaaacttgagttggcaaagatgcagagcagcagtgcagatggcaatgaactctctgaattctcttttaccttatttagaagaatgcagagtaaagggaccttcttggttctgcaggaacttcntcaagggatgaggagacagaacccctacttccaagtgctctatttgtattacccagatgactgaagcttaagagaaggcagggaagtatacaagcagagccagttctggtacaaacaaagaatttgacagggacaatggaagggtcttcttcaccactccttaccttctatgtgatggaaagactagagcttataaaagtacttccatttttttattctcctgaataccaaaggcaattaaagtcagctacaaatgacttgccagtgtcatgttttatttttgttatagatttttaaattatttccttcaagatcanttcttatcccatataatgcttagcttccaagaatattctttactttcttctgtcttttacagctctttgcattttgtagaccttaatactcaggttaaatattcattgcatttataagatcttctgcaaaaagcccagaaatggtccttttcaggtgcctcttcaaagagctgacaccttaccttgtgcctttggcacaaatgtgcagaatagatacatcagttggtgcataatcgaaaaaaataggaattttgaacactgttcttccttctacatttatttctcttcattttagaatcacactttttatgttaaaccagattattattattattattattcaaccagtattaagttgttaaaaccaagggaatggggccctaaccaaaaagaagtctcaactcagaaaaataagtccccagtcangtggttcttactttcttgtgggttgcacattttgtatctctctaacatcagcgtattcctgactttaagcaggtgtttatatgtaaaataaaacctgngtatcgaagggaaatgcattctttttatggagtattgaccctgatcctctatgatgtcatatagagcaactcagggctatacttgctagattttaaccaagcagtttgaaatattaatcatcatcctctcatcttctccantctccattgccaaagtctttgtcaaaactccaaatttgttgataaaagattgtgtttgccattctcatttataatgcagtttctccttaagcctggagttttttgaatgagtgcatgagtaaatgagagaatgtgtgaacgaacatttatgaagtatctaacatgtgccaagcattgtgcctggcactttcaatcattagaatgttttatgtgattccacagcattttctgtatnagagtagctcacaacattttaaatgtttccaatatgaatcgtgttacaaaattcttaattttatatttcatataaattaaagaggaaaaagaaaaggtttataatatattttaaaacaatgtgttactntataatacaactataattgtagttaataactaaaacctcttgaaaatgtcaaagaaatacttgatttctgatgcaactttgactaaaatatttactttagaaataaaaacgttcttattttgctatatcannnnaanngcataattaaaaagcagtgttttatagaaatgctggttattttatattcaaaaagattttgtcacataattcatgggtaaaacttgcagttgtaaattgtgtctgctctggtatgggccctattaatagtcccatgctgttaaatataaagaaaaatatactaaaatattcaaagttccaaataanannnnnnannaanagtatttngagttattttnctttaggtttccttatactcaaatnggctaggtcctatcttttcctctctctctctctctctctctctctctctctnnnnnnnnatatatatatatatatatatatnnannnnngagatatatgagatatatgagagatcangatctatatatgtatntaaatacaattatacacagataatttttaatactctnngttaacaaacacagttgaaaactggtttcggctgcacaaataagcagaatatttgagtaactatatatgatatggagatantttaatccatttatcctggnctcaagaacactgataaagatgattttctgttactttagctcattcagatcaggatggacatgctctttttgatctataactgttcagccagcttccagataatattttaggctatgagagctatacagtctctcttattactcatttctgctgttgaagtatcgaaaacagatagagatactatgtaaagaatgggcgtagntnngttccaggaaaactttatttacaaaagcagatggagggctggatttggtccatgggtcatagttagtgaccctgatcccaagtttattttgtgttagaccctctaacctttgatctgcgtcttttctgttttgatttacataattcatttttaaatcaaaaagatgtgcgtatatatggttgtgtgtatctgtataacctaaagctataatatttngttgtcttgaaagcagatacactcttcctggnagtctgttcaggtttcaggacgattgactataatgaaagagacagaatagggtaagggaagatgggtatgctatcagccattttctttgccttgtcatttaatgccataatttcagattctctatgtaaaaagaaggtctgtgtattgtcaaaataatatactctccaagttctcctgctcattgacccttgaaccaggattctggattgctagagctgcagaaattcacccacttgggtactcttagagctctacagcaagaatatgatagaatgtctgatctttgtgctgcagaaagcaaacttttgaagaattctaagcaacagaaaatgggttatgtgactcatctgctatttggcagccactattccttttttagactgcagaacggtactgcccctgttacctctagaatagcctgagtctgaggagtgcagagaaaagatatatccaaaaggagaatccctttctctntgcataactctcaatcctttacaagtaagtagcattatttcagaatgtctatatgcatcattttcaactaaagcatacctcatccttaaacttccactatttaacagctaatccatttcaaacttggtttgagcctagcaattgcagaactcataaaattgcttgtgaaattacacaccatattactagcatatacattgcagtgctccaatcatgctaacagataatagatttttctttaagaattttatcaaatatttcactatttggggaaattttagaggaggggaagcctgtattcaggatgatagagggagcagagacttactgtctctcttccacattataaatgaactgcctttccaggtccaacatgctgtcaggttgcttcagctcggtgtgaatgtaagtgtggggatcaaacacacacacctatacacatacatattaatatgcagaggattttaaataattgcaaatgtcttgtggctgttttatttctacaaaattctgtaagatgtataccagaaaacataataaagataagctcagttcttcattgggaaaaaatatttttaaagaaaatttagaagtttttgctgaattaaagtatcttcaattttaattactggatttggaagttgaaatgccatccttcaatatcactggtctcaaattcattgatagaattttttcttaaactaataagtggggtaagtataatctcctaaattggtacccactggctgctcctaaactggtttccagtcatgtcctccagtatgtgatttttataaattaaaggtaatattgtatattaaagttcaaataaagatgttctttaagtgaaaaaaaaaaaaaaaaaaaaaaaaaaaaaaaa

SEQ ID NO: 457 - DNA, 1486 bp, Homo sapiens
ttattccactggagaagccctgggggtggctggagccagcctgctgagaagcgtggtgcagctgggtctgggacttcactagagcttactctggagcacctattttctgtgcacatgggagtgctccactccctagcagagcagagggaagtctctgccaggtacccacgccacaggcctcaggatggctttttgtctgagggcctcattaggcccagactgctgctgctggtaccagtctcctgagacactgcctccctggagcccatgcatgcccagctgttcttactgcttagtagccttgaagcagcacatctccactgtccctggcaggattgtgggaggcttcacaacccctgctttcctgacttcctcttctgcccaacactgggtgccccttcccagtttcccagcaggggcttcatgggccaccgtcagtgggtctgggcctgccagagtcgtcttgctcttcctcttgcttctaggcaaccacacttggcaagttaaatgtcccaagcaccttgtctcccttcccaagaacaaaccatttctgtgcacatccttggaggcgagatgagctccttgcagagggccagagtaagtgcaagtcatggagtgcaggcagaggggtccatggcttccccagcccagggagggtatcagtatcattcattctctctcccctcactggtatgggttcagagcaatgcctagggcccctctctgctcccctgcctagtggggtggtagtggctacctctcagccccaatagtccctgctcctcttagaatcttcaccaagtggcaggccacctctgggcaggaccacctgcgtctggcacccaggaggtgaggcagacaccatggttaggtgatagggtctgaacccagttggggagacagaggggttcagacttgggaagaatctgtcagtgtgcatggagtgaggtgtgtgtgtgtggatggatgtgcacgtgtgcatgcttttttttctttttgccgtgaggacagttgaatttggggcatttttctacaagaagcagtcagccttctctcccccataaggactggctgtaaccttaagcccatcaaagttacttccagcctggagagaacctcaccaaacagctggtgtggcctgagggtggccatggtgggaaatgggcatgagaataaatacctccccaaattcaatctgagcccagcaggagaggatggtagggttgccagggctcagaagtgcaagctgattactcaccccaccctgcctcgccgcacctttcctttgtttccttgggtgaatgcaggagcagcagtggctgcccttcccacctggacagtggtgtgtgtagaaagccagctggatgtttgtggtggggcctcatggtgcctaggaggagataaagatgaggaggtttttccttattgtataaatgaatatttgtatgattaaattaacacacacaccaaaaaaaaaaaaaaaaaa

SEQ ID NO: 458 - DNA, 1766 bp, Homo sapiens
ggcaaatccggcccaggatgtagagctggcagtgcctgacggcgcgtctgacgcggagttgggtggggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttc

SEQ ID NO: 459 - DNA, 1348 bp, Homo sapiens
caggtggcgtacttggcttggagactggcgcggcgttcgtgtccgagttctctgcaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaac

SEQ ID NO: 460 - DNA, 3043 bp, Homo sapiens
ttttgaaaacacgctccgggagctagagcctgaggtcggcggcgcacgctgttgccccgtgggcttctgctccctcgcttgtcttctcgggcttctcgccccggccgcggccgggtcctcagtagtcgagaatgactaaaaaaagaaaacgccaacatgattttcaaaaagtgaaattgaaagttggtaaaaagaagcccaagttacaaaatgctactcctacaaactttaaaacaaagactatacatctgcctgagcaactcaaagaggatggaacacttccaacaaacaatagaaaacttaacataaaggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaagcatcaagcattgcacagttctctccaataacatagatcgtctcttactgaatttaacactgtctgatatcatggtctccctggcaaatgcgtcaaccttgcagaaggattgcagttggatagaaatgataaggaaatttgtaacagagacccttgaagatggctctaggctaaatagtaagcaactgaacagattgctgggagtatcctggaggttaatgcaaatacagccaaacagagaggacacagagactcttattaaggcagtttatacattatatcagcagaggggccttatccttccagttcggactttgttattgaagtttttcagtaaaatctatcagacagaagaactgagatcttgtagattcagatatcgtagtaaagtgttatcccgttggctggctggcttaccattgcaacttgctcatcttggctcccgaaatcctgagctctctacacagcttatcgatatcattcataccgctgcagcacgagcaaataaagaattactaaaaagtttacaagctactgccctccgaatttatgatccacaagaaggtgctgtggtggttctccctgcagactctcagcagcgtttggttcagcttgtatatttcctacccagtctgccggctgatttgctttctcggttaagtcgttgctgtattatgggaagactcagttcaagtttggctgccatgcttatcgggatactgcacatgagatcatcattttctgggtggaagtattcagctaaagactggttgatgagtgatgtagactatttcagcttcttattttccacacttacagggttttcgaaagaggagttgacttggcttcagagccttcgaggagttcctcatgtcatccagacacagctttcccctgtgcttctctaccttacagatttggatcaatttttacaccactgggatgtaacagaggcagtttttcacagtttattggttattcctgcccgaagtcagaactttgacatcttgcaaagtgccatcagtaagcatttggttgggttgactgtaattcctgacagcacggctggctgtgtttttggtgttatctgtaagctcctggatcatacttgtgtagttagtgagactctactgccatttctggcttcttgttgctacagtcttctttattttctgctcactatagagaaaggggaagcagaacatctaagaaagagggacaagctgtggggggtctgtgtctccatcctggctctcttgcctcgagtcctcaggttgatgctgcagagcctgcgggtgaacagagttgggcctgaggagctgcctgttgtgggccagctgcttcgactgctgcttcagcatgcacccctcaggactcatatgttgaccaatgcgatcttggtgcagcagatcatcaagaatatcacgacattgaagagtggaagtgttcaggaacagtggctcacagacttacattactgctttaacgtgtatatcactgggcatccccaagggcccagtgcactggctacagtgtattgaagaggccatagtacctcctgtttgaagttgtttattcacatctatcttatttgaagaaaaagactgatgtaatagatctttgtcattaaagctgaacttttaaaaaaaaaaaaaaaaaaaaa

SEQ ID NO: 461 - DNA, 2251 bp, Homo sapiens
gacgtcacggtcactgacagcgtgagcccgcggcggctgctgccatggtggctggcggccgggtaagggtctgagtggatctcctgccaggccagagcgccttcgggggccgcggcggaaggccaggagtttgcagccagggcgccgggtttgtggtctgcagtgtcgtgaggctgaggtgcagcatgtctagactgggagccctgggtggtgcccgtgccgggctgggactgttgctgggtaccgccgccggccttggattcctgtgcctcctttacagccagcgatggaaacggacccagcgtcatggccgcagccagagcctgcccaactccctggactatacgcagacttcagatcccggacgccacgtgatgctcctgcgggctgtcccaggtggggctggagatgcctcagtgctgcccagccttccacgggaaggacaggagaaggtgctggaccgcctggactttgtgctgaccagccttgtggcgctgcggcgggaggtggaggagctgagaagcagcctgcgagggcttgcgggggagattgttggggaggtccgatgccacatggaagagaaccagagagtggctcggcggcgaaggtttccgtttgtccgggagaggagtgactccactggctccagctctgtctacttcacggcctcctcgggagccacgttcacagatgctgagagtgaagggggttacacaacagccaatgcggagtctgacaatgagcgggactctgacaaagaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtgtatggaagccggcaggactttctctggcgcctggcccgagcctacagtgacatgtgtgagctcactgaggaggtgagcgagaagaagtcatatgccctagatggaaaagaagaagcagaggctgctctggagaagggggatgagagtgctgactgtcacctgtggtatgcggtgctttgtggtcagctggctgagcatgagagcatccagaggcgcatccagagtggctttagcttcaaggagcatgtggacaaagccattgctctccagccagaaaaccccatggctcactttcttcttggcaggtggtgctatcaggtctctcacctgagctggctagaaaaaaaaactgctacagccttgcttgaaagccctctcagtgccactgtggaagatgccctccagagcttcctaaaggctgaagaactacagccaggattttccaaagcaggaagggtatatatttccaagtgctacagagaactagggaaaaactctgaagctagatggtggatgaagttggccctggagctgccagatgtcacgaaggaggatttggctatccagaaggacctggaagaactggaagtcattttacgagactaaccacgtttcactggccttcatgacttgatgccactatttaaggtgggggggcggggaggcttttttccttagaccttgctgagatcaggaaaccacacaaatctgtctcctgggtctgactgctacccactaccactccccattagttaatttattctaacctctaacctaatctagaattggggcagtactcatggcttccgtttctgttgttctctcccttgagtaatctcttaaaaaaatcaagattcacacctgccccaggattacacatgggtagagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcagagtggcccacagacattgctttcttatcacctatcatgtgaattctacctgtattccagggctggaccacttgataacttccagtgtcctggcagcttttggaatgacagcagtggtatggggtttatgatgctataaaacaatgtctgaaaagttgcctagaatatattttgttacaaacttgaaataaaccaaatttgatgtt

SEQ ID NO: 462 - DNA, 1575 bp, Homo sapiens
agcttttattttctcctctccagtggggttggcttttattgtttcttgtttgggtttggaatggaaatatggatagcagcataaagtacttttattttgacaaaattcatttttttcaacaatggagacatagatttgacccacaataacttctccccctctctttttactctgctcaaaaagcatctctcctcccattacccaaccttggtcataagtgtgcctggctggtttgcagatatttgttctgctttgtaaaaattggccattagtgcatttattgagatgatctctaaagagctatgccctgacctacccctgattctatgacattggggcccttcttttgctgaaactgccttacgtaatggttttactccttgaaagagatttgacggaatccattttatgccaagtgctgccctgcactgtttctgcaatatgtggtgtatgctgtggtgatcttgctgggaatgattataagtgtgtgtgtgatgggggagtgggtattacatgcattgctgaagagtcatcctggtgttcctcattcctcccaccttcccgtggtcattttaattacggggcagtgtcaccgcaaagggaggaaactcaaagccgaaagcaaaattccaggcctgattctggcttttgaggttcctggttcttgaagccaggcctgacccgactctcagatggggtcagtcccgtcgctttgcagactgaccctggaaatctacaaaatgcagattttcctgatttcctcttctcttgcccagtttttttttttttttttttttttttttttaaagcctggattgtaaccagattttcttttttcccccttctcagctgtagatatgatatctcctttcagggccccagcttaagggcaaagtgagttaatgtgtagacaaaggcgagggacaagagagagttaacatctagacagtggaaaaagccatggtgtgtggtttctgggaaccaccaacacttgcaggtttagctttttcccagggttgactacaagaaagaaaaccatgtttttgcaagattaaaatgtggttgagtgtgcctaaattaaccatccccatttttatcatatttccaccatcacttcagggttttaagagtcagtgctcacctgggcggagctggtagtacattttgcttcttagaaagctaagtcctgggttccgtctgattttaggttccaggaacttcctgagaacacccgatcgcagagggtaattttctggagtttgttttgcagggatagctgggagtatggccaccctgctccacgatgcggtaatgaatccagcagaagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgcc

SEQ ID NO: 463 - DNA, 1947 bp, Homo sapiens
aggttggtctggaccggaagcgaagatggcgacttctggcgcggcctcggcggagctggtgatcggctggtgcatattcggcctcttactactggctattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatactttatattctgttatattgttctgtgtgttcttctggatcccttttgtctacttctattatgaagaaaaggatgatgatgatactagtaaatgtactcaaattaaaacggcactcaagtatactttgggatttgttgtgatttgtgcactgcttcttttagttggtgcctttgttccattgaatgttcccaataacaaaaattctacagagtgggaaaaagtgaagtccctatttgaagaacttggaagtagtcatggtttagctgcattgtcattttctatcagttctctgaccttgattggaatgttggcagctataacttacacagcctatggcatgtctgcgttacctttaaatctgataaaaggcactagaagcgctgcttatgaacgtttggaaaacactgaagacattgaagaagtagaacaacacattcaaacgattaaatcaaaaagcaaagatggtcgacctttgccagcaagggataaacgcgccttaaaacaatttgaagaaaggttacgaacacttaagaagagagagaggcatttagaattcattgaaaacagctggtggacaaaattttgtggcgctctgcgtcccctgaagatcgtctggggaatatttttcatcttagttgcattgctgtttgtaatttctctcttcttgtcaaatttagataaagctcttcattcagctggaatagattctggtttcataatttttggagctaacctgagtaatccactgaatatgcttttgcctttactacaaacagttttccctcttgattatattcttataacaattattattatgtactttatttttacttcaatggcaggaattcgaaatattggcatatggttcttttggattagattatataaaatcagaagaggtagaaccaggccccaagcactcctttttctctgcatgatacttctgcttattgtccttcacactagctacatgatttatagtcttgctccccaatatgttatgtatggaagccaaaattacttaatagagactaatataacttctgataatcataaaggcaattcaaccctttctgtgccaaagagatgtgatgcagatgctcctgaagatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggagtgtttgtgcaaaattttttcctctaatgtataatagtgttaaattgattaaaaatcttccagaatt

SEQ ID NO: 464 - DNA, 1335 bp, Homo sapiens
tgattcggtcccgctgtcctaggcgggatggtgccgctgtgccaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggcttggttccagtgtcagaagcaagcataatcattgctgtgtcctcagcccacagagctgcatctcttgaagctgtgagctatgccattgatactttaaaagccaaggtgcccatatggaaaaaggaaatatacgaagagtcatcaacttggaaaggaaacaaagagtgcttttgggcatccaacagttaatcacttatgtttttagagcatgcaatcttaactttgttaaactattattattgatcacattttgatttttttctctccacatcaggatagtttactgaagcacaatctcttatactagtgggacaaaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacattgaggtatgggccctcctcagtgactttaactagctcagaaacgtactcccccaccaaccccacctcaccgccccctatcccggttctgggagagcattgttattaaggatgcatgacaggaatgttggcagaactggaaagtattaaaaaagcattatcagacagtcttgatattatacattttcagaaatatattaaaaataataaactaaaacccatgatttcaaaagttaaaaaaaaaaaaaaaaaaaa

SEQ ID NO: 465 - DNA, 2489 bp, Homo sapiens
attaccaggcacgcgcaggaaacatggcggcggcgggtgttgtgagcgggaagattatatatgaacaagaaggagtatatattcactcatcttgtggaaagaccaatgaccaagacggcttgatttcaggaatattacgtgttttagaaaaggatgccgaagtaatagtggactggggaccattggatgatgcattagattcctctagtattctctatgctagaaaggactccagttcagttgtagaatggactcaggccccaaaagaaagaggtcatcgaggatcagaacatctgaacagttacgaagcagaatgggacatggttaatacagtttcatttaaaaggaaaccacataccaatggagatgctccaagtcatagaaatgggaaaagcaaatggtcattcctgttcagtttgacagacctgaaatcaatcaagcaaaacaaagagggtatgggctggtcctatttggtattctgtctaaaggatgacgtcgttctccctgctctacactttcatcaaggagatagcaaactactgattgaatctcttgaaaaatatgtggtattgtgtgaatctccacaggataaaagaacacttcttgtgaattgtcagaataagagtctttcacagtcttttgaaaatcttcttgatgagccagcatatggtttaatacaaaaaattaaaaaggacccttatacggcaactatgataggattttccaaagtcacaaactacatttttgacagtttgagaggcagcgatccctctacacatcaacgaccaccttcagaaatggcagattttcttagtgatgctattccaggtctaaagataaatcaacaagaagaaccaggatttgaagtcatcacaagaattgatttgggggaacgccctgttgttcaaaggagagaaccggtatcactggaagaatggactaagaacattgattctgaaggaagaattttaaatgtagataatatgaagcagatgatatttagagggggacttagtcatgcattgagaaagcaagcatggaaatttcttctgggttattttccctgggacagtaccaaggaggaaagaacccaattacaaaagcaaaaaactgatgaatacttcagaatgaaactgcagtggaaatccatcagccaggaacaagagaaaagaaattcgaggttaagagattatagaagtcttatcgaaaaagatgttaacagaacagatcgaacaaacaagttttatgaaggccaagataatccagggttgattttacttcatgacattttgatgacctactgtatgtatgattttgatttaggatatgttcagggaatgagtgatttactttcccctcttttatatgtgatggaaaatgaagtggatgccttttggtgctttgcctcttacatggaccaaatgcatcagaattttgaagaacaaatgcaaggcatgaagacccagctaattcagctgagtaccttacttcgattgttagacagtggattttgcagttacttagaatctcaggactctggatacctttatttttgcttcaggtggcttttaatcagattcaaaagggaatttagttttctagatattcttcgattatgggaggtaatgtggaccgaactaccatgtacaaatttccatcttcttctctgttgtgctattctggaatcagaaaagcagcaaataatggaaaagcattatggcttcaatgaaatacttaagcatatcaatgaattgtccatgaaaattgatgtggaagatatactctgcaaggcagaagcaatttctctacagatggtaaaatgcaaggaattgccacaagcagtctgtgagatccttgggcttcaaggcggtgaagttacaacaccagattcagacgttggtgaagacgaaaatgttgtcatgactccttgtcctacatctgcatttcaaagtaatgccttgcctacactctctgccagtggagccagaaatgacagcccaacacagataccagtgtcctcagatgtctgcagattaacacctgcatgatcactgttcttgcttttttgggaagagacactttgttgcaaccctttttcaagtacttgaaagttgaaaatttgaaatcttggtattgatcatgctttaaggtttatgtaaagaaagtgtactgatgttcttacattaaagctttacaaagatttaaactaattatttttgtagttacttctaccaaatagcctttccttttcgataacattcctcagtatttttatagccaagtacattttattttcttgctgatgaactggaattggataaatattgcaagtggatgagttggaaattatgcactttgaaaaacattcactttgtttaagcttattgggtttcagatttgattaaattaaatgtggaggctttctatagcattctaagctgagaagtagattgttacccagtaatgaaataaaaaataaaaataaaagg

SEQ ID NO: 466 - DNA, 1538 bp, Homo sapiens
aggccgaggcgggcggatcacctgaggtcgggagttcaagaccagcctgacaaacatggagaaacctcatctctagtaaaaatataaaaattaggcgggcgtggtggcgggcacctgtaatcccagctacttggagacagaattgcttgaacccgagaggcggaggtggcagtgagctgagatcgtgccactacactccagcctgcgcaacagagcgagactccgtctcaaacaaacaaaaaagtcagatctgtgctagacgctgaaaggaattaatcagacaggatctcagtcttttaaagaactttcaaatacagagaagaggtggtaacaaatcattagtgtataatattgcaagcgaaaaaccagaattgtgtgctaagtactggggtaacacagagatggtaattaattctttctggagaaacagcagtgaatgtgacaacctgagtgagggtggaaagcaggagaatttctagactctgaatttcagaagcttccggaactaaaatgatgtggaagttgagtgagtctcggtgggatattgctgctgcacctggtcaaggccgttccgtcagtgttttcagacgccctgggaacgcggctgcagggtccggtcttcggtttgcacagctagaggccgcgcacagcaaaggatgagcggaaccttggaaaaggtgctgtgcctgaggaacaataccatttttaagcaagccttttctctcttaaggtttagaacttcaggagagaagcccatctattctgtaggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaagttatgcaatgccaaccaaaaccatagaagtgttgcagttgcaggaccaaggcagcaaaatgctcctggactcagtgcttaccacccatgagcgagtggttcagatcagcggtttgagtgctacgtttgcagaaattttcttggaaataatccaaagcagtcttcctgaaggagtcagactgtcagtgaaggagcacactgaagaagacttcaagggacgattcaaagctcgaccagaactggaagaactgttggccaagttgaagtagctactgtagaccctttcatgccagcagtggtcatattgagtgccaaagagaagagcttactgggtagttagagttcatcaggagacccaacccttagatttcataagtacccattcccatagccagtaatgtcctcactcctctgtggcttggctgtacttgccatttcttaccacttacctatgaggtaatgcttgttatcttccatctaataaaaatctgctgcagatgtgtatatgtaaa

SEQ ID NO: 467 - DNA, 658 bp, Homo sapiens
  modified_base (12)..(12): a, c, g, or t
  modified_base (18)..(18): a, c, g, or t
ggagcctcacgngagcgnggtaacgttatagtatttgtcagaagttggggtctccgtgggcattgtgatccgtcccaggcagtggattaggaggccagaaggagatcccttccacggtgctaggctgagatggatcctctcagggcccaacagctggctgcggagctggaggtggagatgatggccgatatgtacaacagaatgaccagtgcctgccaccggaagtgtgtgcctcctcactacaaggaagcagagctctccaagggcgagtctgtgtgcctggaccgatgtgtctctaagtacctggacatccatgagcggatgggcaaaaagttgacagagttgtctatgcaggatgaagagctgatgaagagggtgcagcagagctctgggcctgcatgaggtccctgtcagtatacaccctggggtgtaccccaccccttcccactttaataaacgtgctccctgttgggtgtcatctgtgaagactgccaggcctaggctctctgtagagagtcttcaagatcccggagtggtagcgctgtctcctggtgaaggagtatttgtcacactggaatgtgactgtgtgtgtatgtatgtgtatatatatatatatatatatatataaacaagtttgttgacacctacaaaaaaaaaa

SEQ ID NO: 468 - DNA, 1154 bp, Homo sapiens
gcagccaaagccccaggagccctaggttccaaccaactgatgcccctgtgcccactggcccacgccatgcagccccagtccgttctgcacagcggctacttccacccactacttcgggcctggcagacagccaccaccaccctcaatgcctccaacctcatctaccccatctttgtcacggatgttcctgatgacatacagcctatcaccagcctcccaggagtggccaggtatggtgtgaagcggctggaagagatgctgaggcccttggtggaagagggcctacgctgtgtcttgatctttggcgtccccagcagagttcccaaggacgagcggggttccgcagctgactccgaggagtccccagctattgaggcaatccatctgttgaggaagaccttccccaacctcctggtggcctgtgatgtctgcctgtgtccctacacctcccatggtcactgcgggctcctgagtgaaaacggagcattccgggctgaggagagccgccagcggctggctgaggtggcattggcgtatgccaaggcaggatgtcaggtggtagccccgtcggacatgatggatggacgcgtggaagccatcaaagaggccctgatggcacatggacttggcaacagggtatcggtgatgagctacagtgccaaatttgcttcctgtttctatggccctttccgggatgcagctaagtcaagcccagcttttggggaccgccgctgctaccagctgccccctggagcacgaggcctggctctccgagctgtggaccgggatgtacgggaaggagctgacatgctcatggtgaagccgggaatgccctacctggacatcgtgcgggaggtaaaggacaagcaccctgacctccctctcgccgtgtaccacgtctctggagagtttgccatgctgtggcatggagcccaggccggggcatttgatctcaaggctgccgtactggaggccatgactgccttccgcagagcaggtgctgacatcatcatcacctactacacaccgcagctgctgcagtggctgaaggaggaatgatggaggacagtgccaggcccaagaactagaactttcaaacgttcccggggcctcagacaagtgacaaccaaagtaaatgctgcttttagaactgt

SEQ ID NO: 469 - DNA, 2187 bp, Homo sapiens
cagagcagcggagctgccccgaacaaagatggcgcgggaagcgtctgtgagggcagactgatccgagcacccaaaccctcggcggacagcggagccagtggtagccgcacggccctaaaaccatggaggagggcggcagcactggcagtgctggcagtgacagcagcaccagcgggagtggcggggcgcagcaaagggagctggagcgcatggctgaggtcttggtcaccggggaacagctacggctcaggctgcacgaagaaaaggttattaaagatagacgtcatcatctcaagacctacccaaactgttttgtcgcaaaagaactgattgactggctgattgaacacaaagaggcttctgacagagagacggcaattaaactcatgcagaaattagcagaccggggcattattcaccatgtgtgtgatgagcataaggaattcaaggatgtcaaactcttctaccgctttagaaaggatgacggcaccttcccattggataatgaagtgaaggcctttatgagaggacagaggctatatgaaaagctgatgagccctgaaaacacactcctgcagcccagggaggaggaaggggtcaagtatgagcgcaccttcatggcatctgaattcctggactggctggttcaggaaggtgaggccaccacgaggaaagaggcagagcagctttgccaccggcttatggagcatggcatcatccagcatgtgtccagcaagcacccatttgtggacagcaatcttctctaccagttcagaatgaacttccggcggaggcgaagactgatggagctgctcaatgaaaagtccccctcctcccaggaaactcatgacagtcccttctgcctggggaagcagagccatgacaatcggaaatctaccagctttatgtcagtgagccccagcaaggagatcaagatcgtgtctgcagtgaggagaagcagcatgagcagctgtggcagcagcggctacttcagcagcagccccaccctcagcagcagcccccctgtgctctgcaaccccaagtccgtgctgaagagacctgtcacctctgaggaactccttactcccggggctccgtatgcaaggaagacattcacgattgttggtgacgcggttggctggggttttgtggtgcgaggaagtaagccatgccacatccaggctgtagaccccagtggccctgcagccgcagcaggaatgaaggtctgtcagtttgtcgtctctgtcaacgggctcaatgtcctgcatgtagactaccggaccgtgagcaatctgattctgacgggcccacggacgattgtcatggaagtcatggaggagttagagtgctgagctcctgggcctcccagccctccagtggcctgtgggtgagggaagccagaatgacacaaagcaatgcaaagacaagattgccatgcaaatggatggttttggacatacgagtcttctccgcacatacatgtctaaagttgagttttatacactgaatgtggaagaaccgggtatcatatcttttttaaaaaatgtcagtgtagaaaacatttgggaaaccattttcctacatgatagaactgccttactagatttctatttgtagctctcattcattgttttttatcttagtttgcagaaaggtgttgaaatgcttctctagcccaaacagcgacatgctaaagtccccttcttcagagtcaatagagtagttgttaaaggttttaaattgtactttctccaaaattagcatgcagctatttaatagggaatctagatttcaccaagattcaaatcaaagcaacatttaaaggaataagacctgttcactagcattttcaagggggttctaaagcattcaagtgcttaaaagccataaaaaatgacttcttaattcctgcctttagtgtcaacttttaagttaatacaggtttcaattgtggcattaggaaaaaaaaaaaaaccttgtgatgctatggttgggggtagttagggagagactacatgaaattgtgtgcccctattttctttctgatcctaaatcattttgttttataaatcagctatagcatctttctagaattaatcctgaatatgttgaatgttaaaatagagaagtttgtatatacacataattaaaaatcaacccttctggcaaaaaaaaaaaaaaaaaaaa

SEQ ID NO: 470 - DNA, 3345 bp, Homo sapiens
cagatgtccagttccagatgcctggacccagagtgtgggggaaatatctctggagaagccctcactccaaaggctgtccaggcgcaatgtggtggctgcttctctggggagtcctccaggcttgcccaacccggggctccgtcctcttggcccaagagctaccccagcagctgacatcccccgggtacccagagccgtatggcaaaggccaagagagcagcacggacatcaaggctccagagggctttgctgtgaggctcgtcttccaggacttcgacctggagccgtcccaggactgtgcaggggactctgtcacaatctcattcgtcggttcggatccaagccagttctgtggtcagcaaggctcccctctgggcaggccccctggtcagagggagtttgtatcctcagggaggagtttgcggctgaccttccgcacacagccttcctcggagaacaagactgcccaccttcacaagggctttctggccctctaccaaaccgtggctgtgaactatagtcagcccatcagcgaggccagcaggggctctgaggccatcaacgcacctggagacaaccctgccaaggtccagaaccactgccaggagccctattatcaggccgcggcagcaggggcactcacctgtgcaaccccagggacctggaaagacagacaggatggggaggaggttcttcagtgtatgcctgtctgcggacggccagtcacccccattgcccagaatcagacgaccctcggttcttccagagccaagctgggcaacttcccctggcaagccttcaccagtatccacggccgtgggggcggggccctgctgggggacagatggatcctcactgctgcccacaccgtctaccccaaggacagtgtttctctcaggaagaaccagagtgtgaatgtgttcttgggccacacagccatagatgagatgctgaaactggggaaccaccctgtccaccgtgtcgttgtgcaccccgactaccgtcagaatgagtcccataactttagcggggacatcgccctcctggagctgcagcacagcatccccctgggccccaacgtcctcccggtctgtctgcccgataatgagaccctctaccgcagcggcttgttgggctacgtcagtgggtttggcatggagatgggctggctaactactgagctgaagtactcgaggctgcctgtagctcccagggaggcctgcaacgcctggctccaaaagagacagagacccgaggtgttttctgacaatatgttctgtgttggggatgagacgcaaaggcacagtgtctgccagggggacagtggcagcgtctatgtggtatgggacaatcatgcccatcactgggtggccacgggcattgtgtcctggggcatagggtgtggcgaagggtatgacttctacaccaaggtgctcagctatgtggactggatcaagggagtgatgaatggcaagaattgaccctgggggcttgaacagggactgaccagcacagtggaggccccaggcaacagagggcctggagtgaggactgaacactggggtaggggttgggggtggggggttgggggaggcagggaaatcctattcacatcactgttgcaccaagccactgcaagagaaacccccacccggcaagcccgccccatcccagacaggaagcagagtcccacagaccgctcctcctcaccctctacctccctgtgctcatgcactaggccccgggaagcctgtacatctcaacaactttcgccttgaatgtccttagaaccaccttcccctacttcatctgttgacacagcttttatactcacctgtggaagagtcagctactcacccgctattagagtatggaggaaggggttttcattgcattgcatttctgaaacattcctaagaccctttagttgaccttcaaatattcaagctattctgcagctccaagatgcaattatagaaacagctccttttttattttatgtcctctatatgccaggtgcttcacctgttatttcacttaatcctcataccatatttgcaaaggatgtgttattatctatgtgtgacaaatgaggaaactgaggctcaggggataaagggacttgcccaagtcccacagctggtgtgtgactgcagagactgtgctcttcccagtgtgctgcaatacttctcaaccctcctctaacctgctgtgtcacccgctttccctcccagcccccacatccttaccattttccctccctgggaattcctgcttctgcgaaaatggtatcctctagctcacactttcctaatggccccatctcctgcagaagccaggtgagcccagcactggactgaagttcttgcagacaccccacctgtgcccctatcatcaggggaactgctccacctgagaggaccaactctttaatttttagtaaaacctgaaggtgatgggccgggcgcagtggctcacgcctgtaatcccaacaccttaggagtccgaggtgggtggatcacgaggtcaggagatccagcccatcctggccaacatggtgaaaccccatctctactaaaaatacaaaaattagccgggcgtggtgacacgtgcctgtagtcccagctactcgggaggctgaggcaggagaatcacttgaacctgggaggcggaggttgcagtgagctaagatcacgccactgcactccagcctgcggacagaccaagacttcatcccccccaaaaaaaaaagattggaggtgatttacagtgaaagacacaaataaaatacaactgttcaatggaaatagaaaataaacaccataaaagagagaagagaggtaatttgttagcatcaagagtcaagttgctatatggtcaaaggttaaatttatctctaaaaaatggcaggattcaaagttgtacatacatgtgattacttctgttttttacacccacatacagtacaaaagattattaaaaatattcccaaaaggcaggtgcaatgatgcacacttatacccccagccactcaggaggctgatgcaagaggatcgcttgagcccaggagttgaagtccagcctaagcaacatagtgaaaccccatctccaaaaatataataataattctctcaaaatactaaacagaggtggttttattgataagattttggctgtttggttttccactattctctattggctaaaatttgtttaatgagcatgaaatgtttttattttattttgcttatttttatgattgcaaaaaatgatatgagtttctccctgccaaggcaaaaaatatatatatatacctataaaaaaaaaaaaaaaaaaaaaaaaaaa

SEQ ID NO: 471 - DNA, 3472 bp, Homo sapiens
  modified_base (1009)..(1009): a, c, g, or t
  modified_base (1439)..(1439): a, c, g, or t
  modified_base (1493)..(1493): a, c, g, or t
  modified_base (1517)..(1517): a, c, g, or t
  modified_base (1663)..(1663): a, c, g, or t
  modified_base (1777)..(1777): a, c, g, or t
  modified_base (2012)..(2012): a, c, g, or t
  modified_base (2283)..(2283): a, c, g, or t
  modified_base (2935)..(2935): a, c, g, or t
  modified_base (3122)..(3122): a, c, g, or t
  modified_base (3238)..(3238): a, c, g, or t
  modified_base (3356)..(3357): a, c, g, or t
aaatcggtacaagatggcggagggggacgaggcagcgcgagggcagcaaccgcaccaggggctgtggcgccggcgacggaccagcgacccaagcgccgcggttaaccacgtctcgtccacgacctccctaggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgctntgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccngccacactgtttgcggtcatgtttgctatgtatataatctcaggactgactggncttcattggcctaaactctatagnctgtcttgtgtaaccttgtcatggagttagcactgatatttctttgtacttgggcatatgttaaatactctggggagttcagagaaattggaacagtgattgatcagattgctgaaacactatgggaacaggtgttttccaaactntttgaagttactagacgtcgaatggttcaccgtgctctttcatcagcacagcgacagagactgtcatccaacaataacaagaagaaaaattagacagtatttttaacctttttntctatctgaagtgttcacacttacacatgtaggacaataagcaggaccgtctgggccggtctgcataaatgctgtatacataccagatttgatgctgcatatagggtatggaattgcacatccatctcataggaattgtaaatggtttgaataagaggaaagtaatttttgttgcattataaaatgtctagtagcatcataagtttttttgagagaagcatctttttatttcccntattcctggttattttcatcattgctttgaattgaatttttatatctatttttatatgtaactctttttttacctcatgtttttgtttgttttgcacatttctcataccacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctcttttttttncatgcttgctgtacaatgagaactcaaataaaaataaaccaaagtttacaatcaactgtagaagtagtttagtgtaactggcttcacagatggctgccacagagtgtgaagattgtttgttagttttaagcattcttttaatggctcctaagacatgcagatggactgaggagcattggttaatcatgcacctttgtgccatgtttaactcttttatttctttttacttaatctaatgttagtgaatttgtcttatgtaaaaggatatttcagggaaatattttcagaaatctatttagagtctctttaacacagtgtcccattgaaattttaatttttagagaatttatgaatcactgtttcaagaaccagattggaaagacaatgaagcctttattgagccactacattaaaagtatatattgctttactgccttcaataccagtattacatcaatgcatgtatcagaaacttcacagaaattacatggcaactcttgtagctaagaaagtaattctgaggtgtacatttgtcttgcctttttaaatttataaacttgccctaaaaggagatgcatatctgggaaactgaactgtctttttgcagtttagccttcatgtatataaaatatgccattaattttattggggnaagaaattccatccaaaaatgttgcctacagctatgagttaagagtgtctgtacagtgtgtagcttttattttctaaaatcacagatagggcatgtatatgacttataaatatataaatacgattttgtattaaaagttttgtagtttatggcaaaatctggtcctgtggtaggctaaataagtacngtccctgtgaaaggaatgtttgtggctcatgtcagtgtgtgaatgcatagacaatttgaagtttttgatatatttgtgatatttatcttgagcactgcaatctcaccccccccccncccaccaagggaattcaatgggaatgtttattgtgactttgtcctctgttgcattttaaagttatttcctgtaatttattttcagtacataattaaaaatttgttgtatatataaaannaaaaagggtctgtaaaaaaaaactccaaggggggggcccggtcctaatttcgccctaatagtgagtccgttttacaattcactgggccgtcgttttacaacgtcgggactgggaa

SEQ ID NO: 472 - DNA, 3521 bp, Homo sapiens
ggggggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggagcggctgggagaggctgcggagccgcggtcgccgccctcggaggcactggacgccgccactgtcggggcttcctcaaagctgttcgtaggtcgcccgcgccgtctcgagccttttacccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaacatcagcaaatggcttagaaacatagatgagcatgccaatgaagatgtggaaagaatgttactgggaaacaagtgtgatatggacgacaaaagagttgtacctaaaggaaaaggaggacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgacttcatttttaaatgtacttgctcagctcaactgcatttcagttgtattatagtccagttcttatcaacattaaaacctatagcaatcatttcaaatctattctgcaaattgtataagaataaagttagaattaacaattttattttgtacaacagtggaattttctgtcatggataatgtgcttgagtccctataatctatagacatgtgatagcaaaagaaacaaacaaaagccaggaaaacactcattttcgccttgaatatgtaaatgggattaattttgtcctgtgccttatgtggaaaggaacttctttggttttccttttttgttctggtggaagcatgtgcaggagacatatcatccaaacataaaccattaaaatgtttgtggtttgcttggctgtaattttcaaagtagttaattgaggacaaagggtaatgcagaagtgatagctttggtttgctgagtcttgttttaagtggccttgatatttaaaactattcctgccaccatttcttctccttggccacttcttccttgcgtctccctgcatgctgctttatttgcttctccctccccaaccacctcatggtatatttaagagtgaaagggacaaactagtaggtttgtcaagtttaatataaagcactgatgtaacttgctaggtaaacggaaagataagttctaactgcctactatccaatgtcagttaattggtgtcttcccccctcatttgctctcttccctaaaatgtgtcccagatgccttcatttgctgttttacttctatgttctgcttttcctcctctctttgttcccttcctgtctatccattgagtttatgaaatggaagagttaactgcatgcactagtgtttggagggtgttgtggtttgtctttctaattaggtgtatagcctattcactttcctagaataaatctcttaacctaaatttgagtagtctgcattttggcaactcctctagcagcttggtagcctagtacaggttgttttttaaaaaaaggaaaagcaggaaggaggagtgaattttattaacatgtttgccaaatgtattgagatttggcctctgaagaacactttttcagtgttaagtttctttaccttaagattcagaaatactttagaatattattaattttaagtcctgtctttacatccttttggaaaacttgtattaccatgagtttggaaaaaggacaacgaaaggcttttcatgtaaagataagatctttggctatctctaaccctgtccttttttcactgcattttttctagttttgcttcattgcttatcattaggatagggtaagtgaagtttgctatgctgctagcatcctaagatgatacctttgttgaaagaattgtgaatagcatgattcatttctagcagaggctgagtttaggactgcagcttccattgagaagtctttctgtgtcgtgaatagcattttaatgacctcttggctcacataagcaaacaacatagggacgtatctgctatgaaaatccacaaatttttcagatagtgccctaaaaacaattttatatgcctcactggttgttattcttaggttattcccacacttgactttatcattgtttactactagtaaaaagcagcattgccaaataatccctaattttccactaaaaatataatgaaatgatgttaagctttttgaaaagtttaggttaaacctactgttgttagattaatgtatttgttgcttccctttatctggaatgtggcattagcttttttattttaaccctctttaattcttattcaattccatgacttaaggttggagagctaaacactgggatttttggataacagactgacagttttgcataattataatcggcattgtacatagaaaggatatggctaccttttgttaaatctgcactttctaaatatcaaaaaagggaaatgaagtataaatcaatttttgtataatctgtttgaaacatgagttttatttgcttaatattagggctttgccccttttctgtaagtctcttgggatcctgtgtagaagctgttctcattaaacaccaaacagttaagtccattctctggtactagctacaaattcggtttcatattctacttaacaatttaaataaactgaaatatttccaaaaaaaaaaaaaaaaaaaac

SEQ ID NO: 473 - DNA, 1188 bp, Homo sapiens
cagggctgggcggcggcggcggcggcggtcatggaacgccaagaggagtctctgtccgcgcggccggccctggagaccgaggggctgcgcttcctgcacaccacggtgggctccctgctggccacctatggctggtacatcgtcttcagctgcatccttctctacgtggtctttcagaagctttccgcccggctaagagccttgaggcagaggcagctggaccgagctgcggctgctgtggaacctgatgttgttgttaaacgacaagaagctttagcagctgctcgactgaaaatgcaagaagaactaaatgcgcaagttgaaaagcataaggaaaaactgaaacaacttgaagaagaaaaaaggagacagaagattgaaatgtgggacagcatgcaagaaggaaaaagttacaaaggaaatgcaaagaaaccccaggaggaagacagtcctgggccttccacttcatctgtcctgaaacggaaatcggacagaaagcctttgcggggaggaggttataacccgttgtctggtgaaggaggcggagcttgctcctggagacctggacgcagaggcccgtcatctggcggatgaggctaagaatcttgttagtgtcacttttgacattagcaagatgaacccttaaccctcgattcaattgccttacgcacgcttttcacagtgactagccaaggggaggtggggttgatttctgttcctaactacacctgcatatgtcagggctccagtcagcaaaaggtatagatgttgcctctaggcatgaggtcattggtcacattctacttggagacagtgattgcattcattgatttcatggttaattgctagttggtaggtaaaggcctctagatgattagcaatcttgataaaagaggcctagtaatgttcttttgaggttagaaatccttgctgctaggacagtctctgtgacaggttgcgttgaatgatgtcttccttatcaatggtgagcccaccagtgaggattactgatgtggacagttgatggggtttgtttctgtatatttatttttatgtacagaactttgtaaaaacgaaactatttaaaaaacaagaataacatttttagcatctttattcaaggagatttatggacttcaatttgtctatcaaacattaaatagctttttatttccaaaaaaaaaaaaa

SEQ ID NO: 474 - DNA, 1355 bp, Homo sapiens
  modified_base (1301)..(1301): a, c, g, or t
gggcaggcagttgaggtggattaaaccaaacccagctacgcaaaatcttagcatactcctcaattacccacataggatgaataatagcagttctaccgtacaaccccggaggcgcagaccgtccacacgggacagggacgcccgctcggctccgctccgcgctgatcctcaaggtctcgcggtttccccgccgcccacccggacgccgacgaaagccagcgagctcctcagcctcaggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacgttcagaaagttgctgaagtttgtggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctccctgcagccgagcgtcctgatgcagctgaagctttcagatgggtcagcataccgctttgaggtccccacagccaagttccaggagctgcggtacagcgtggccctggtcctaaaggagatggcagatctggagaagaggtgtgagcgcagactgcaggactgacccctcacttgaccagtcccattcagatccggcttggacaggcacctgagatggtgccaaagtgcagctgactcttcccacgacagccctggccttcccatcaggcaggctcttcagtgagtgtttgaacgtaattatgtagttttctgtttaattgaaaaagagagctatgcctttttttctttttggaagtaaagcagctaaaacatgtttctataggtgagtgttggaccttcacacctccccttccctgtacatttgtctttggtgctggacgtggccatgtgaggccaggttgaggccctttgtagacaacatacagttgctcagcntggccccatgtagccaggtgcttttgtagatcttgtgtttcaggcagggcccgg

SEQ ID NO: 475 - DNA, 1273 bp, Homo sapiens
acgatggctactggggagctcggggacttgggtggctactacttcaggttcttgcctcagaaaaccttccagtctctgagctctaaggagatcaccagccggctccgccagtggtgaggaaccgaggcgcagggagagaagaggcccttggtcttcgcggctgtggaggcgcaggccgggcgtcgaggggcccgcgcgggtcggcgccattctgagtgaaccctgaggcttcctgagtgaaccccgaaccacccgggaagggcggatgctgtgggtgggatcggttatcggtgcgctctgagagggtgccagcccccagatgatttctttttcctcctctgccccaggtccatgctgggcagaatcaaggcgcaggcgttcggctttgaccagacctttcagtcctatcggaaggatgatttcgttatggcttttttcaaagacccaaatgttattcccaatttgaagttactttcagattcttctggacaatggatcatattaggaactgaagtgaaaaaaattgaagctataaatgttccttgcacacagctttcaatgtcattttttcatcggttatatgatgaagatattgtacgagacagtggacatattgttaaatgtttagattctttttgtgatccatttctcatttctgatgagttacgaagagttttgctagtggaagactcagaaaaatatgaaatattcagccaaccagatagagaagagttcctgttttgtcttttcaaacatctttgccttggtggagccctttgtcaatatgaggatgtgattagcccatatctggaaacaacaaagcttatctataaggatctggtgagtgttcgaaagaatcctcaaaccaagaaaatacagattacctcttctgtctttaaagtttcagcttatgattctgctggtatgtgctatccttcagcaaagaatcatgaacagacattttcttactttattgtggatcctatcaggcgtcaccttcatgttttataccactgttatggtgtgggagacatgtcttaatgttctttcagattatgtacctctactattttgtatttatcatttttctatcttaatactaacttatagataaacatatactttgcaaattaattcaagaaaaatgtaaggagcctacttagagcagaagaaagcaaacaccaagatgcctttttaaaaatttgtgtggaatactaaccggggatcaaatttcatccataataaaatctataccaaaaaaaaaaaaaaaaaa

SEQ ID NO: 476 - DNA, 2195 bp, Homo sapiens
  modified_base (134)..(134): a, c, g, or t
  modified_base (1932)..(1932): a, c, g, or t
  modified_base (2068)..(2068): a, c, g, or t
  modified_base (2141)..(2141): a, c, g, or t
tctctttttttttttttttttttttcgttcttttttttgttttttttttttttttttttttttttttttcacattttttttggatttatttaaagaacacacaaaaaagtgcatctaaatgatttttttttttnaaaaaacaatgtctttaattcctcatatgctgacttggcaatccatatgcagcctaaaaggtggttgaaagatgtctgtggacttctacacaaattgtttaagattattgaatttgatacaagaatacgtgaagtgtcttcttgagtggtaatgggcaccctgtagttatttgctcagaaccactcacacacccttcccctccccacacacacttttgccagttccccctggtgaaccataatacacacgtgggagacagctggcatcatctgagtcttggaatagctttcttgtttgttatctgcaaaaagctaggtggcctttttagtatcaaatttcaatcttggcctcactggaaccatgctctacagagctttcccaacagtttagcaagtaagcaaaatcagcttttgctcttcatatttcgtaggtgagactggggcttttaaaagaaatatttcataaaaaagacaaaagcataaatgagaaattagagggattttagttatcattaaaggaaaaaactcacaaattgatcccatttgttccatggggaagaaaagtattataaaaggaaataacttgatttttaggtttgaagggggtcccaatctaataataaaagtcttttgataaaaccatcataaaaataaaaactaatttaaaatataactgccagtgttttttaggatttaaaaaggtgagatgttccaggtttaagcaaatggttccttgggttgccaaatgcattcccatgagtgtttcttaggctgagggaatagagagccatgctcaatctgtttacccgtaaggactgaaattcaactacatgtacacatttaagacttgccctagttcaatggtcagctcaagtactggagatttaggctactggctgtgtaccggcatgggaagctgtcttcaactctttcacaactcacgccagaacagagaagcttgacagggcaggaaaagcgagcaactgcgtgtcaaacctgcaggtgaaacccctagtgtagaagagcaactatttatttgtcaacactacagattttgtttttaaaaattaagcttagtactaaaaagtcaaaatttttttgcatgatagaggagtgtaaataaagttccataaaccagtatacatatgcttatgagccaataatcttaaaaagacaaaaaaagctgcatggatcctaaatgactatgtaaatagatccactccaggtcaaaaatattgtaagcacaagtcttaaattcttaatagcaaggattagaatgaaagaagaagctgagcagtagcaatgctgggaggaagtactgtgtattgaatattattccctaaaaggaatagaggaggggagaaaaagcacaattctgattgctcttttcacatttcagtatctcagaacttcatcgaaaataggaaaagctaatccagaaactctcatctgctcattatcattgctgaagggtgttttaggaatgacagaattactcccccagggacaggctgtgtgtggtagaaagccactctcacaaggaggctggctgaggagggggactttgggaggaggctaagtcagcaagcaagtggcctctgaggttctggctttcacgtctgtgacactgctgtggaactggggagacatgagacccctctactgtgggttctgttggttaaaaatgcaacagactacatttatagcacttcagtcatttaaaaaacaaaagcttatcctccttcccctaccctacccaactgtaggaaaggagaaattcatgaagcatttttttttnaaaggtttctgcagtgctatgaaagttcaaaggtaaaacctaacagccccacattgttaggatgatctccagggaccctgaattggatacttgaaggttgatagaaactgaaatgagctggacttaagctgctggntcactccctccacaccacagtcatttctgtttgttccacctggagtggtcccgtgccacccctcagtgaaccntccgggcagcagcaggggggctgtttttgggaagctactggttttgccatttgc

SEQ ID NO: 477 - DNA, 620 bp, Homo sapiens
  modified_base (40)..(43): a, c, g, or t
  modified_base (45)..(46): a, c, g, or t
  modified_base (48)..(49): a, c, g, or t
  modified_base (51)..(52): a, c, g, or t
  modified_base (54)..(55): a, c, g, or t
  modified_base (57)..(62): a, c, g, or t
  modified_base (64)..(68): a, c, g, or t
  modified_base (70)..(80): a, c, g, or t
  modified_base (91)..(94): a, c, g, or t
  modified_base (353)..(353): a, c, g, or t
  modified_base (609)..(609): a, c, g, or t
  modified_base (611)..(613): a, c, g, or t
  modified_base (615)..(615): a, c, g, or t
agagctgtgacagctggctacactgctggcagttcacacnnnntnntnntnntnntnnnnnncnnnnntnnnnnnnnnnnttttttttttnnnnttcctatttttgtttaatttatttaagaccacctccttacaacttccagagagaaaatacaaaacaagaaacagacttggtttcaaatgcataaccaggtgctggagtttaaagcattactgataacattgttacagaagaatggcagcttactccagggcacttcagtattcctgaggaataaacatgatttctcttgtcctcccgctgggatgttctcaggtgaagtcactgctcctgctctttgacatattttccntgtagaagatatggagcctggaaatcatgctgacagttggaataagccattcctaatcccatgccagaaccgaaggctaatggccacattcttcttttaaagaaggtaagtgagaaaacaattcctaatccaaaaccagtacctatcttcacgaccgcatccgccagacaccggtcccacttcctgccgagctccgactcagacatgttccccacccgcgcctccagctttcctctcggccggcccccgcgctccnannncntgaaa

SEQ ID NO: 478 - DNA, 2619 bp, Homo sapiens
  modified_base (719)..(719): a, c, g, or t
  modified_base (820)..(820): a, c, g, or t
  modified_base (823)..(832): a, c, g, or t
  modified_base (834)..(838): a, c, g, or t
  modified_base (840)..(840): a, c, g, or t
  modified_base (1164)..(1164): a, c, g, or t
  modified_base (1323)..(1323): a, c, g, or t
  modified_base (1883)..(1883): a, c, g, or t
  modified_base (1914)..(1914): a, c, g, or t
  modified_base (1923)..(1923): a, c, g, or t
  modified_base (1947)..(1948): a, c, g, or t
  modified_base (2080)..(2080): a, c, g, or t
  modified_base (2418)..(2418): a, c, g, or t
  modified_base (2513)..(2513): a, c, g, or t
  modified_base (2577)..(2577): a, c, g, or t
  modified_base (2595)..(2596): a, c, g, or t
  modified_base (2606)..(2606): a, c, g, or t
  modified_base (2610)..(2611): a, c, g, or t
  modified_base (2614)..(2616): a, c, g, or t
  modified_base (2618)..(2618): a, c, g, or t
ttttttttttttttttttttttttttacattttaaaaaattatctttatttaggtttctgattcagcacatgtatcaaagactaatcaacataaaggagtaaataagacattaattgaaagtcttacatctctctaaactctgaccaagaatgtcaagattgccactattaccagaactccaacctagtcaagttgtagacaagctatcatgaacaacatacagtgtgcacagatatgcagaggcaaaaggcatgctagcgcttggctctcctcttttccttgttgacatctttctgttggacagtccactttcgctttccaggctaagttccaaatcaagtccaaagaaggctcagggtcaacctgaccagatactcttctggaggaatgcattcttaaactgttgtgcctgcaactttgtttttgccaggatgaagttcagaccgagatgtacaatacaatctagatgacggtgcagactaagtcaagaactaaagttgtgcagtaacccgagttaaggcatgaatgcagacacacacatgcacacacacagcacccatgctatcaagacacaggattttttcagttgcctcatgagaggcaacctgggcttggcagttaatcagaactgctgagcattccagaaaatgccccccacgactttatgctaacagctgtgtgtatgttttaatcaaaaaattaaagaagaaaaaaaaanccctaaaaaacaaagaaaaaaacaaacaaaaaatcaccaaaaacctagaaaccccttaatctcttacaatggctcttgagcatggaactcatgtagcagcntcnnnnnnnnnntnnnnnanaatttggaaataaaaggttgttttactatgtatttctttggtagtcatcactacaaagttttcagtgttggttacctataagacaagtactagacagaagatcaagttacacagaaatatttcttctgtactgataagatacaaatattgagctctcaaagcacaagttactatgctttttcttgccttattgggcattctctaaaagcaaggctttgtgcaggaaaagttcatgtctacctaacaaagggtgatacatgttctattttcctacaagtgaacaattaacaaaaattcacattatcaattatttctggttgaatnctgttagaagccaattacaaagggacagtagcacttggtgtcaaagccactttctggtcacacattcattccatggttgctagtcagtatctcaggagctcagaatttaaaactcctttcagtcaacgaaggagtaagttcaattaaaggcttccactntctgccaaatttctagaattctgtctagagtgctagcatgcttgatgagagaaagcagttcagagcccaaagaggtgtcaggtattaggtaagttaatttggttttgtataaaaggcatggtaatctggcaacagagtacttatcctattagcagcacagtggtagccaagggtctctgtctgcaagacaggaaaatgaagctactgaagcccctgttgctcccacctgcctgcaggatggctactgattttacaaaggccttctgggagccaatccagggctcacctgggagagtgggtaacagaatggcaggaaccatgttcagcccccatgagaagtgcccgactgagggaagtcagcttcccataggtgagggggctgttgccattatgggctcagaatctaaatcttactgatccctagtagtaagacaattgccaagaaattgtcctagcaggtactacccaagtgttacaggctctgcataggtcctcaaacactttaaaggacacgaaccatcaaattcaaaagagtagtgtttgttctatcagttctgaantgtccacagggagaggcaactagatttatgntggaaaaangtgctgtttgaaggagctgtgttnnatttcgaagtgaaatgactttgggaaccagaacatttctgcagatgtctgaatatcaagaacctatctctaaaaggcatttatcaggaaatgttcgctcactccaagtgctttttaaaaattcaacatatgncaatgttttaatttttgtgctttcaagaggtaactaaatcgataggaagctgagggaagatcattccattatggactttcttgtttgggtgcaagacactatccacagcattgaaatctataatctcataaaagattcttataaacatataccatatttctcctataagaaaaactgagaactgtaccatgaaggcaaaatttgtttgcctactctcagaattccttggaatggcaatgtaccaggagggtgagtgaactgttggtgaaaattccgggtttgacatggcccagtctgatcacatcaaaaacctaaagcctcaatgattaaatgccaancttcttccctgcatctgagaactgtattatgattatgtatattacacatacattataaataaaatttatatagacctacagtttcttccaaacanttgagtgatgttctcagtttgggggtggaagcaggaagaggtgaaaaaatcttattgttgcttntactctcaagttcttaanncgctagtcancacnnttnnncnc

SEQ ID NO: 479 - DNA, 4873 bp, Homo sapiens
  modified_base (263)..(269): a, c, g, or t
  modified_base (271)..(274): a, c, g, or t
  modified_base (277)..(284): a, c, g, or t
  modified_base (304)..(304): a, c, g, or t
  modified_base (1857)..(1857): a, c, g, or t
  modified_base (1860)..(1861): a, c, g, or t
  modified_base (1870)..(1871): a, c, g, or t
  modified_base (1884)..(1884): a, c, g, or t
  modified_base (1893)..(1893): a, c, g, or t
  modified_base (1904)..(1904): a, c, g, or t
  modified_base (1915)..(1915): a, c, g, or t
  modified_base (1949)..(1949): a, c, g, or t
  modified_base (1951)..(1952): a, c, g, or t
  modified_base (1954)..(1957): a, c, g, or t
  modified_base (1988)..(1988): a, c, g, or t
  modified_base (2150)..(2150): a, c, g, or t
  modified_base (2162)..(2162): a, c, g, or t
  modified_base (2502)..(2502): a, c, g, or t
  modified_base (2737)..(2737): a, c, g, or t
  modified_base (2932)..(2932): a, c, g, or t
  modified_base (3371)..(3371): a, c, g, or t
  modified_base (4004)..(4004): a, c, g, or t
  modified_base (4011)..(4011): a, c, g, or t
  modified_base (4021)..(4021): a, c, g, or t
  modified_base (4028)..(4028): a, c, g, or t
  modified_base (4051)..(4051): a, c, g, or t
  modified_base (4055)..(4055): a, c, g, or t
  modified_base (4057)..(4057): a, c, g, or t
  modified_base (4076)..(4076): a, c, g, or t
  modified_base (4079)..(4079): a, c, g, or t
  modified_base (4081)..(4082): a, c, g, or t
  modified_base (4086)..(4086): a, c, g, or t
  modified_base (4102)..(4102): a, c, g, or t
  modified_base (4114)..(4114): a, c, g, or t
  modified_base (4188)..(4188): a, c, g, or t
  modified_base (4232)..(4232): a, c, g, or t
  modified_base (4234)..(4234): a, c, g, or t
  modified_base (4236)..(4236): a, c, g, or t
  modified_base (4313)..(4313): a, c, g, or t
  modified_base (4317)..(4317): a, c, g, or t
  modified_base (4323)..(4323): a, c, g, or t
  modified_base (4327)..(4328): a, c, g, or t
  modified_base (4331)..(4331): a, c, g, or t
  modified_base (4337)..(4337): a, c, g, or t
  modified_base (4340)..(4340): a, c, g, or t
  modified_base (4342)..(4342): a, c, g, or t
  modified_base (4346)..(4348): a, c, g, or t
  modified_base (4352)..(4352): a, c, g, or t
  modified_base (4361)..(4361): a, c, g, or t
  modified_base (4364)..(4364): a, c, g, or t
  modified_base (4383)..(4384): a, c, g, or t
  modified_base (4401)..(4401): a, c, g, or t
  modified_base (4816)..(4816): a, c, g, or t
  modified_base (4845)..(4845): a, c, g, or t
cttttttgcttctgctttaaaaataggcttctgaggactgtgaattactatcgttaaaataacaatgatggagattccatgcactgtaaagcacttcagggaagagaacaaaaatcacaggaattgaatcaacaaaggaaaaatgagaagcacaaagaaaacctaggacatttccctttttgttttaaactgggaaattctaactccttggaggaagacaatgatactctgattcaagagagaagctaaaaaagcacaagtcnnnnnnntnnnnttnnnnnnnntttttttttttttttttttntcagcagaaatcacaaatttattaactcttaaatatatcaatcagtcctttaccattatggcaagaaatatatacagtgtcccatggtaaactgcagtgtttcaaaatgatagaagataataaatgtgtaattcatttgtggtggagagaacaaatcacaatttcctcacatcttagtgcggaagacaaacttgatctacagtaatacttcaacaccacatgctaagttaaaagtgtaaaaaaaacactctacatctatttttttttctttaaatacatgtatgccacgtatagctgcttcacaaaagggtaaaagaaattaaaaagagaaaaatgaggccattattttttcacagatctcattggcaggttaacatggctcaatatatttactgtatatatttattttaaatatatatgttgttttaaattgtgtaataattatcagaaaagcttcaacccatctaccatacatccactagcaataatatctaagatgattagtaatcaacacagagaggtgagatgagagaaaagaggaagggttgtttttgttattttgtttttcttttttgcttctgctttaaaaataggcttctgaggactgtgaattactatcgttaaaataacaatgatggagattccatgcactgtaaagcacttcagggaagagaacaaaaatcacaggaattgaatcaacaaaggaaaaatgagaagcacaaagaaaacctaggacatttccctttttgttttaaactgggaaattctaactccttggaggaagacaatgatactctgattcaagagagaagctaaaaaagcacaagtcacaaagatcaagttcaaaacacttatgagaatggcaaacatttgtaagcctctctaacactagaaaactagctagtgatgatgcagaagtgaccctttcattccccaaggcggaggtgagtgcgtttgcataaaaccccctctgctatcaagttggtatcctcctggcaactgtcccaatcagtaagacgttgcagtcacaggaggaacttgcttttatcctaactttaaacaatgcaaatacctccaacatagttaggatacctaagtccaaactagagcttaagcagaattataaacctttaaaatcttgacaacatttttgtgggccctgaagatgatcaaaagtgctagtatagctaccttcaaaagacttttatttcccttttacattcattatgcaaatttcacttctattcttttctcacacactactagccagcctccccaaaaaaggaaaagggaaaaaagtaagaaaagaatggaacaaaagaaaaataagaaagcaaacgaaaggaacaaagaaacaggataaagaaaagagatcacagatttgagaaagaaaaacaattcaattcagcaaattcaccaaaacaatgtgaatatatcctaaagtgattaaactcagaaatgatgtgaatttttccagtttacacagtttgaccaaaaacagcatggctttatgtggtagcaaaccaactgattcttgcttctactttcataantgnnttttgcccnnatatcatcccacntttaattgnttaatcagcanaaactttcaangaaaaatcatccattttaaccaggatcacaccangnnannnnaaggtgtattttttttttaccttaaaaaaanaaaaaaaaaaaccaaacaaaccaaaacagattaacagcaaagagttctaaaaaatttacatttctcttacaactgtcattcagagaacaatagttcttaagtctgttaaatcttggcattaacagagaaacttgatgaagagttgtacttggaatattgtgnattttttttttngtctaatctccccctattgttttgccaacagtaatttaagtttgtgtggaacatccccgtagttgaagtgtaaacaatgtataggaaggaatatatgataagatgatgcatcacatatgcattacatgtaggaccttcacaacttcatgcactcagaaacatgcatgaagaggaggagaggacggcccagggtcaccatccaggtgccttgagaacagagaatgcagaagtggcactgttgaaatttagcatgggtgtattaacaaagaagctgacagcctggaaatatttacttgatgggtactgttggtgaccccgagcgatgaaaatgaacattctnccactttccatcccggcggtgccacacacgagtctcttctgactgcattgtctttggcattccactgccatccatgtactgtgtgagcctaatatatgctatgcaggcggcatcatcccctaccagatgtacatgagggtttagaataatagtgtggattggtttattgcttttggacaaagcattttcaaagtagaatcggtgaaaatccatcccttccactaaattacccaangcttcaggttcaaaagcagtaaggcctgggtcacagatttttgtgtaggcttcaaagtccccattgttgatagcttcgatcagttgttcagtgactttgataatctcttgctttcgtgctttcacatcttcatcctcaattgttgtatttgaactctcagttgactcctttactccatctggtttcttcaacaanctcttggctgctgagaaattccttgtagccagcatagttgtcaagatggcaccctttagttttcttctagcattaaatttcttcaagcagtctacagtctcctgtctgtgcatcatggaagcaacagtagaacgttgacagatccatgggtgcttcagtgcctctgaggctgtgatgcgtttggcagggttgatagtaagcattttattgatgaggtctttggcttcaggagtcaccgtgtcccattctggtgatggaaaatcataagctccagccttgatctgctgatagagtctgtgttggtcttcatcccagaagggtggataccccacaagtagaatatagagaatgacaccacatgcccacatatccactggctttccataaggatctttacgtaaaacttctggagaaagatatccaggtgtgccagcaaaanccaaaccacgcctgctggtccccttgaacttctatggctaagccaaagtctgccaatttcacagctgctcccttggatttgctagctaaaagcaaattctcaggcttcaggtccctgtgaactatgccatttaggtgacaatgattaacactttctagaatctgctgtatacaatgactggcatcagcttcactgtagtattctcttgccactatgtcttcaaacagttcacctccagtaactaaatcaaacaccaagtagtgaaagccctcttctgatatgctatcatgaagtcgcacaatattagggtgcttcaaaagacggcagattctagcttctctttctagtttctgatgatccctagcagaaagctttttggtgttgataattttggcagcatattcttgtccagtaggaattttcatacatcttctcaccactgagaatgccccctttccaagctcctcgaaaagctgatactcgtccgtgaacctggtgcaggttgtggtcgaagccatcctcggtccgggctgtgccctggctgggagcgcgacggaccagaagcgagcagacgcgcggctaaccccgggactggccccgcggcgctgtcacccagggccgctcttactttcntggtccnaaagtagctngcccgcnagggagtgtgcgcaggggcgggncggnangggagatgaccagaaaggntgncnngggntctcctccccacagtncgccgatcctcnctcctcctgcgggcctcgcttccttcttctccactggacgctccacccgccccttttccagtccctgtccccanatgcagggggtaaagtactcaagaagagggggccgggaaatggnanancagccaggcacgggacgagtggcaagcagttgcgaaacgatccgcactggagcaggaggagtagaagcagagggganggantccgangggnnggnaggtgngantngcannngggnccgaggccncgnagcccagagcggacagccnnagcccagcggccgctgntcagcaggctcaggcgcggggcgcgccggggctccgacgagcgtgcgcgcccgaggccggcttccctccggcgggcggcagcggctccggcgaagcgaggcaccttggcggcctcgcgctgctcacgagcccgcgcggcttcaagacggcgcggcgagagaaagagcgctcggctcaggcgaagcctcttctgccgtccccaggcctccgtctcctcctccggcgcctcctcccgccgctccctccgcctgccagcaccccctccctggcgaagccccctcctcgctggtcccacacctccctctagcgactccaagcctgtcccttcgtggatctctcgcactccctcctttggttgcacacacgagcacaccagtctagggagaaaccaggtgggtggaggaggatgtgcggnggagaagactggaggtttgggtgaatgangcgagaagtcacagttacccatttaaac

SEQ ID NO: 480 - DNA, 1929 bp, Homo sapiens
  modified_base (1088)..(1088): a, c, g, or t
  modified_base (1522)..(1522): a, c, g, or t
  modified_base (1525)..(1525): a, c, g, or t
  modified_base (1830)..(1830): a, c, g, or t
  modified_base (1920)..(1921): a, c, g, or t
ttttttttttttttttttttttttttttttttttttttgtatttaaatacttttattttcatttcacaaaaaaagcaacagtgtttgcagctacacatgcctttcagtcagtgctggtcatatgcaaaacaagttatcagaaatataaagaaaaataagccttttccctttacaagtgaaacaacacaatttgcatatacaatattatatatacatattttcaaaatgtttcacaaaagacagattatgatacaaatttagaattccacccacaagctcagactcaaggaattgaagatctctataggtgtttaaatataaaaatgtaatacctttacaagtttccaagtaactactttccaaagtatttgaaagaggctattcttcacagcaacatggaacacttggctttaatcaagacagctgtaaaactaagttttgtctcaatgtgagtttgttgattaatgcaaatgctccaattatgccataattctcattttatatacacatacatacacagcgtattattgtactgatggtttacacagtccaatttctggagcatttccttcagctaagccatgacctttacttcctttgaagtattttaaattaagaactgttcagaaatatcactaatgactaccatgactaactccaaaaaggtgcccttttttcttttatttatgatcaaatgtaaatgtgtcatgaataaacttatttttttctatggcagcaggtataagtaatagcaaagtataggctactttttcaacactagaatctgagagtttgatatacagtatgtaacatttctttgcaaattttctaggagttctatcactcaatgtttccaaaatagtaatatggcaaatcttcagcatggagtagtagtatcagaaatgggaaaacaaacaatgctaagaggcctgaaggaagggaggagagcagagagggagggagggaggatgtgtgcccatgcattttccctgatgcagacaaatgtggagttttaacatttaccatatggtagatgaggagacagtgtgatataagaatgcttaaagcgaacatacaggtctggatanatgatatgcacacaaaatacaaggctaatgaggcagcaatggcttaaatttgtgaatgccagtgaagaaaacacctaacagtataggcactaaagacaaaatggaaagcacacaatggagaacggaggagaaagatgcagtcacacaaaagacctctgggtaagaaagggccaacttgtcttgccacatgtgggggatgaaagatagaaaattccttttggatttagttttggggctcatgttctattcatcagagccatgtcaataactcgaaagggtcattccaagacacaatttctaccaggtacacaagctatgcaattgatggaatcataatagacttctatagatgaatcagaagtccaggcctcaaaaagaagctactcttaacggtttgcaaatgcgttctagacagcactcttattggcttatcngcntcgccggtttaccagttactaaaagatatatgagcaatgaagtttaaacacagctttattcaatattgtcctcttgcctttctagaatttacaaaagcacaggtcccttttcactacctcattcaatctgaatcaacataagaaatgctggatctaattagctttcacaactcaaccatagctgagtgtcttctcctgtcttatctgctgcacacctgttgctattagttacattaatacactgctacaccttccagccagatggcagggatttagtaggtctttatttttgttaggtatagtcnagaccccttgcaagggactaagtgttaaaggaaaataatggcggaagaaagaagcaaatgatatatatgcatctacacacttgcatcctnnatggaata

SEQ ID NO: 481 - DNA, 4136 bp, Homo sapiens
  modified_base (40)..(41): a, c, g, or t
  modified_base (43)..(43): a, c, g, or t
  modified_base (57)..(57): a, c, g, or t
  modified_base (66)..(66): a, c, g, or t
  modified_base (70)..(70): a, c, g, or t
  modified_base (106)..(106): a, c, g, or t
  modified_base (110)..(110): a, c, g, or t
  modified_base (131)..(131): a, c, g, or t
  modified_base (160)..(161): a, c, g, or t
  modified_base (341)..(341): a, c, g, or t
  modified_base (381)..(381): a, c, g, or t
  modified_base (508)..(508): a, c, g, or t
  modified_base (517)..(519): a, c, g, or t
  modified_base (716)..(716): a, c, g, or t
  modified_base (720)..(720): a, c, g, or t
  modified_base (846)..(848): a, c, g, or t
  modified_base (850)..(851): a, c, g, or t
  modified_base (856)..(857): a, c, g, or t
  modified_base (894)..(894): a, c, g, or t
  modified_base (946)..(950): a, c, g, or t
  modified_base (953)..(953): a, c, g, or t
  modified_base (956)..(958): a, c, g, or t
  modified_base (961)..(968): a, c, g, or t
  modified_base (971)..(974): a, c, g, or t
  modified_base (976)..(982): a, c, g, or t
  modified_base (984)..(984): a, c, g, or t
  modified_base (987)..(989): a, c, g, or t
  modified_base (992)..(995): a, c, g, or t
  modified_base (997)..(998): a, c, g, or t
  modified_base (1001)..(1005): a, c, g, or t
  modified_base (1007)..(1009): a, c, g, or t
  modified_base (1011)..(1013): a, c, g, or t
  modified_base (1016)..(1019): a, c, g, or t
  modified_base (1021)..(1022): a, c, g, or t
  modified_base (1024)..(1024): a, c, g, or t
  modified_base (1092)..(1092): a, c, g, or t
  modified_base (1172)..(1172): a, c, g, or t
  modified_base (1213)..(1213): a, c, g, or t
  modified_base (1238)..(1238): a, c, g, or t
  modified_base (1246)..(1247): a, c, g, or t
  modified_base (1283)..(1283): a, c, g, or t
  modified_base (1558)..(1558): a, c, g, or t
  modified_base (2048)..(2050): a, c, g, or t
  modified_base (2052)..(2058): a, c, g, or t
  modified_base (2060)..(2061): a, c, g, or t
  modified_base (2063)..(2064): a, c, g, or t
  modified_base (2066)..(2066): a, c, g, or t
  modified_base (2068)..(2069): a, c, g, or t
  modified_base (2071)..(2071): a, c, g, or t
  modified_base (2073)..(2080): a, c, g, or t
  modified_base (2112)..(2112): a, c, g, or t
  modified_base (2116)..(2116): a, c, g, or t
  modified_base (2177)..(2177): a, c, g, or t
  modified_base (2257)..(2257): a, c, g, or t
  modified_base (2261)..(2261): a, c, g, or t
  modified_base (2498)..(2498): a, c, g, or t
  modified_base (2501)..(2501): a, c, g, or t
  modified_base (2534)..(2534): a, c, g, or t
  modified_base (2540)..(2540): a, c, g, or t
  modified_base (2550)..(2550): a, c, g, or t
  modified_base (2558)..(2558): a, c, g, or t
  modified_base (2562)..(2562): a, c, g, or t
  modified_base (2676)..(2676): a, c, g, or t
  modified_base (2870)..(2870): a, c, g, or t
  modified_base (3114)..(3114): a, c, g, or t
  modified_base (3127)..(3127): a, c, g, or t
  modified_base (3137)..(3137): a, c, g, or t
  modified_base (3661)..(3661): a, c, g, or t
  modified_base (3675)..(3675): a, c, g, or t
  modified_base (3679)..(3679): a, c, g, or t
  modified_base (3681)..(3683): a, c, g, or t
  modified_base (3685)..(3691): a, c, g, or t
  modified_base (3693)..(3693): a, c, g, or t
  modified_base (3695)..(3695): a, c, g, or t
  modified_base (3697)..(3706): a, c, g, or t
  modified_base (3708)..(3708): a, c, g, or t
  modified_base (3710)..(3714): a, c, g, or t
  modified_base (3787)..(3787): a, c, g, or t
  modified_base (3793)..(3793): a, c, g, or t
  modified_base (3801)..(3801): a, c, g, or t
  modified_base (3842)..(3842): a, c, g, or t
aggaaactgaggcacaaagaaaagactgtaaggcagagcnngnatttaagcccaggncctggtccnttangttttgggggggttttgtttgttttacagactatantttnagagaagtagattgaggaganagctcattgaaattgttcattttctgtanngaactagaaggcctaatttcatttttatttttacttgtgtcaacttatttttagacttggactattgagaatcttatatgttgttcctaaagcgacacacctaacagcttcaaaaggactatattacagttgaacccatggtagtttggatcctactgatacttgatgaggatctttacntagtgttttatgttagttttgggtgatgtagttgagtccnccacttactgagtttacctactgtgtatgactgggctcaatgataaatagaatggttatatcaacactcaaatgagggctgacacacttcacctctccttttacttaagatctctctgcattttttnttttttttnnngaagccaagtaagcaagaagaaaaatgagagataatgcttcagtgagagaggaaaggtgctacatagagtatgagctgttaagttacatcccaggggaaagacctgggaactattgtattattctcttgaaaatttggcccagtaagctgctacatccagttcaactaacaaaatcctgtataccacagagaagaanaaanaaaaccaaactgacaaacatccttcttttatttaagaccaaactgcagctggaatacccagtacagttctgcttactacacttcaagaaagatctgaaagcggaaaaagaaccaaagaagggcagnnnanncgacnnaagggtgggtggaaggtgctgcagtatgaatactgtncgaatattttgactctggtctgaaaagataaaagaatgttatcgaaaactannnnnaanaannnaannnnnnnnaannnngnnnnnnngnatnnnagnnnnannaannnnnannncnnnttnnnncnngnggaaactaatccctaaatatgaataggtttatattgattcatgggtaacaggtccataataaattatnggaaactaggatgtctgaatatcaaggaagacagccatagtctcttacagtgcctctgttggtctgtctcaaactgaatngggtgggaaaaggtatggtccaatataaaagttccattttngccattattggcaaatcttgccttngtttattnnggtgccagtgttttctgcttaatcatttgctttgtnggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgtttngtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcacaaaaaaaaaaaaaaaannnannnnnnnannannanannangnnnnnnnncctatacattgatttcatcacatttgattttngtcntcttttttgccacatacttaaaactttccatataaaattaactaaaaatctggaagtggantttaagcttttaatttgtagcaattttgaaaatatagcagaggtatattttcaagggaggtgtgaaatggaggtattatngttngtattttattttagaaattttgtttgaacttgcccaagatcacacagcaagtgtcagatcctaggttacagcccataatttttcacttgtttcatcttttgttaccatgtttgttgtttaatccaatggggaagtgtttttatagctttattttcatggagatagtaacattgatataatgggatctagaatttacttagagtcaaagtgactagatttaattacaaaaagtatttngtngtataccgttatacactcattaacataggggtncttatngacagaggtnctatgtantttnaaaagaatatgtagaggctatagacttttttgccctctacctcccttctccatttccttttgaagttaagacatttaagggggagaattaaggtgcatattgagttggggtttngtttaaaaaaaattaggtaaatacatatataactacaataacaacagttggtagttctctaaaatatttaattatggtaaatcagaaaaggccctttaatttttgcatctgttgaatgaattgctttaggatctcttctgtggttgtttctctttatactgaatgctgtcaatattattgagcacttactgtgncgaaccatgtgcttttcaaatatttctatttaatcctaaaaacactcctgggaaatgggtattattcccattttacagatgagaaaattgtcctttgtagaatacccatcatgtgatagcttcttgcatattatgctattcatttctcacaaccttacaaggtaaatggataatgttcctggatgagagattaaacgtactcgaagatcttatggttgtgtggctcagagactctaagcatggntttccaaatctcnattctcttgntagagattttccattgtattgcattttgaccatgttcctgtttacaaaacctaagattatattctgaagtatctgtgacttgagtgatagctcaggaataatctgagggcattctattaggaaggaggactagcaaagcctatagttagcctatcctaggcatgaactattctcattttagataggatgacttgataaataggatgaagtgagcaacctgtttgtcttcggttattggtatctacaagacattctgctagtcactgtggaaaagtttccttctcttgggttttttcctcttccccttcctcttaacagtgttggttatctttattatgtttctgtgtatttgtaacagctgtttcacccttgtattgcataatggggatttttcttggaataaaaagtgaggcatgtaaattcattgagaactaaccgtagtttgtaaagaagtaaaaggcctttgtatctagttttttgcagatcacatttctttgaatgctggaaagtgaaataaactggtntaggagccaaaaanaaanannnannnnnnntnanannnnnnnnnnanannnnnaaccacctgggtacaactttttcctaatttgtgtaagaggttttagagatgcactctgtccctcttgctttancaaatngcctacangaatgcaaccaaaatactagaaactgaaacttacacaaaanctttcaggttttttcctgtgttgtagttctagggaagaggatagtttattagtatttattttaagcttaaggataggttttggacctggattccatcatagtataactgccatcgaaaagaagacaaattgaaattacagcatttacctaaggttcacagtatggctgacttcagcagccttacatggtaagttctctgtaccagctatttttggttctcgcaattgcatcgacttgggaaattcctatcaccattctctatataggctaaccaaaacttttatcagtaccttt

SEQ ID NO: 482 - DNA, 1856 bp, Homo sapiens
  modified_base (31)..(34): a, c, g, or t
  modified_base (460)..(460): a, c, g, or t
  modified_base (657)..(657): a, c, g, or t
  modified_base (1529)..(1529): a, c, g, or t
  modified_base (1617)..(1617): a, c, g, or t
  modified_base (1631)..(1632): a, c, g, or t
  modified_base (1675)..(1675): a, c, g, or t
  modified_base (1682)..(1682): a, c, g, or t
  modified_base (1694)..(1694): a, c, g, or t
  modified_base (1740)..(1740): a, c, g, or t
ttttttttttttttttttttttttttttttnnnntacaagactttgtttattaataaagtaattcattatgacttttgaaaaaaaaagttttaaaatgttctgtgtacatgtcaatgtaggttaggccagccaaaagacaaagcaaagcatcaacattaagtcacaggctaggattatacaaataagaacaaacacaaggcttatggtacttgttaggtaaacacaaccaaactaaactgtacttcaaatttgtttatataaaagcatattaaagctcactttaaaatagtgtccatcttttcttttaaacgggcatagactcatttgcagtcatgtacaaatatacctaatagctttcttcatcttttaatacaagtacaattccttgcttctttatgcaacctaacaaaataatatagaatgaagtcattagaaaaatatgaacctttctgaatctanattacatttttaatttaaattggaaaatacagtttagatcatatgaaacatatggatttcagacatgtattatctgtttctaacagattattacaggcggtctttattttggctgaaatgcaaaaatatgactttcttaataacagattagttaaaaatactttccattgatagcagtgctagtccctagaacaaanggtaagcaaaacttatttgtaagttactgcctattcaatgcccagaatatgtagatcctaaatctaagcccttaatatacatctactttaaagataactgaaagatctcacatgcctgataatccttaatttaaaccgtcctgtaaacatagtcaaaatctgctaatagaaatacaattcaagtaaacattgcatatttgatttaaaccaccttacagttaaattcactcatgacacattggatcataaccactaatatgtaaaaagttttaaaaaaatcatccttacgtatagatgaaaataaactttgtaaacttgttcatttaaaataacgaatgtactgcagctgctctttggtttggcatagtttcaggtactgaatattcaagtaaatttgttcccaggtaaaccaagtctcctaatttgtctgtaatggcaatggcaagacctgaacttcaactttatttttcttaaggtgtcatcacaaagtgtttgaaggaccaaagatagtacttctaaaatttgacagggcttcattttgattttttctccccaaatagttgatagcaataatcaataccagttgagataccaaagaggcagcctttccctgattcccacaccacttgtaggcctttgctagaatggtcattaatacgtatgaatcagttgagctaaatattatttagaacgtggcaaaatgctggctgtaaattaaatcaaagataagtaattcaaaggctttaactgaaaatttctgaaaagatgtttgctgtgctattaaagatgttaaataacaaaaattaaaagaactgagaaagactataccatgaaagtgcataatagtgaagaaaaaaatgaagttcccttgncgttagccaggtgcatgcaaatctttttatctgaatgtagaaatgcaaaaagtaccaggagaacatttctgaaagtagtcaagtatgntttaacatttatcnnccttataatatgcaaactgccaaactggagttatgtttttagntggtaantgatatatatanatatttttgagatggagtttcactcgtcgcccaggctggagtgcanaggctttccgttttaaaaaatatatcttctgttatacttcagttatttcattccactgatcattttcttgcaaatgaaaattgaaaataccagtctataatgttttcatacaccta

SEQ ID NO: 483 - DNA, 3145 bp, Homo sapiens
  modified_base (486)..(486): a, c, g, or t
  modified_base (488)..(490): a, c, g, or t
  modified_base (493)..(500): a, c, g, or t
  modified_base (506)..(506): a, c, g, or t
  modified_base (510)..(511): a, c, g, or t
  modified_base (513)..(513): a, c, g, or t
  modified_base (1055)..(1055): a, c, g, or t
  modified_base (1506)..(1506): a, c, g, or t
  modified_base (1674)..(1674): a, c, g, or t
  modified_base (2243)..(2243): a, c, g, or t
  modified_base (2258)..(2258): a, c, g, or t
  modified_base (2260)..(2262): a, c, g, or t
  modified_base (2265)..(2272): a, c, g, or t
  modified_base (2274)..(2277): a, c, g, or t
  modified_base (2280)..(2280): a, c, g, or t
  modified_base (2765)..(2767): a, c, g, or t
  modified_base (2770)..(2776): a, c, g, or t
  modified_base (2778)..(2781): a, c, g, or t
  modified_base (2896)..(2896): a, c, g, or t
  modified_base (2928)..(2928): a, c, g, or t
  modified_base (2990)..(2990): a, c, g, or t
  modified_base (3087)..(3087): a, c, g, or t
  modified_base (3089)..(3102): a, c, g, or t
gcagccctagcctctccgcacttctcgtcgctcgtccgtgttcactccacgcctggcctcgggtaggagccgcatagcgccaacggttgcgggtcgcaactactcccaggcggcgcgccttgcgcgccgggcctcccaggaccgcggcgagttcagaaggcgcggggagagaagtgaggtcgagcagcgggcggcttttgacgaacggccctcacagccaatgggaagcccggtcgactttcccgcccctgccaatagggagcagaacccgggccggggggggcgcttcccgcaggctgcggctggattcgatcctgcgcgacggccgcgaaggcgggggcggaggctcggcctgcgcggctgggagcggcttaggggaggagggaagaccggaagccacggttgcgtccccatccttagattcgctcctccgggcagggagcggagacggaggaggaggagggagaggctgaatgttggctcggnannngannnnnnnngaggancggnngnacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtatngttatattcaagagaaatgggatacaagcaatggttgagtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaatngttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgttngcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaattngttgtaagcttaaanannnaannnnnnnnannnnaanatagaatatcataatgtagactatctacagcttcattgtagattatacagatatatgatttctaaccttattactggaatttttcttccacagtaaaaatatatttgcattcttaatgctaattatctgcaagtattttttcattgtgtaagagattaatgcaggtgaaagtattgcattttaatatagaattcctattatatgtttagatgtttaagtatgttgcagttactcatattaaacataacttgtatatttattattttaatgaagtttgagaataacgttacatatgttgaattttaagtactacagatttaactgattttatatttctgaaaggctaacagacatggatacacgtgtacagtatgcattcaaacttatttaaattggtgtatttttttttaagtcactgtccatttgtattgacatgcctctgtttctagtccagtttggagattttataaagttataacaatgannnaannnnnnnannnncatttgttgcatgtgacttaaatacagctagtatttggcattgagattttaatagaggttataattaacagttcctcttatagataataatctgggatccatgggtgggcttcanagaatctgtgtaccccctaaaattgtatgtanaattttggatatttacatttttattttttaactcttggatccatcagtaatatgtatttttntatatggtacaagatttaaggatctaattttatttttattccaaacagatagctatttgtctcaataccatttattaaacattctttctcccactgnannnnnnnnnnnnnnttttttaagataatagattttatacataggcaagtaagattta

SEQ ID NO: 484 - DNA, 2044 bp, Homo sapiens
  modified_base (13)..(13): a, c, g, or t
  modified_base (71)..(71): a, c, g, or t
  modified_base (218)..(218): a, c, g, or t
  modified_base (262)..(262): a, c, g, or t
  modified_base (298)..(298): a, c, g, or t
  modified_base (477)..(480): a, c, g, or t
  modified_base (482)..(488): a, c, g, or t
  modified_base (490)..(493): a, c, g, or t
  modified_base (495)..(495): a, c, g, or t
  modified_base (510)..(510): a, c, g, or t
  modified_base (512)..(512): a, c, g, or t
  modified_base (514)..(522): a, c, g, or t
  modified_base (1492)..(1492): a, c, g, or t
  modified_base (1547)..(1547): a, c, g, or t
  modified_base (1550)..(1550): a, c, g, or t
  modified_base (1566)..(1566): a, c, g, or t
  modified_base (1568)..(1568): a, c, g, or t
  modified_base (1570)..(1571): a, c, g, or t
  modified_base (1575)..(1576): a, c, g, or t
  modified_base (1606)..(1606): a, c, g, or t
  modified_base (1813)..(1813): a, c, g, or t
  modified_base (1860)..(1862): a, c, g, or t
  modified_base (1864)..(1866): a, c, g, or t
  modified_base (1869)..(1877): a, c, g, or t
ttttaaatcaatngataaacatgatttattactttgtctattaaagtagtttcaacacaattgaagtttanactgcactgggctgttcccatcacagtccaggattatgcacagaccagcccccaaccccagcaggggtgccctgccagaacctgtgctggatgcctaggagcacagagaccactgcccgttgttgggctgcgtgtgcacaattcatnccccgatccataatccctaagacaagaatggctgtcattgcccntgggttcactttctattcaaagaggactcatttggncacagccaatgtagtagttaaaatgcattttgagaaaaaataaatattctgtacaatgtatttacaaggatcaaatgttttgtaacccacccccaattagtttcccaattgggaaactataatttgataattaagaagcatattattggccgttagtgtcacgtcaacaaagaatgtgnnnntnnnnnnntnnnntntttttgaactatatntntnnnnnnnnnttttacgcaaaatttcacattttaatatgcttagaaggagtttttaaagaagtagaaatgatttccttggcctctgactttcagtgatgaaaatgcaaccatgcagtcccccctttgcagaagggcagttcttcccaggctttctggaagcaggggcttccgaggagtctccacccacctcacagaacactcactatgagccctgcacagacagcaggattcacaatctccaatagggatggcaggggcagcccttaaaacttgaagaggtcgatgaagtgctgcggagacacaggcgtgaagcagctgtcagggtcggccgccgtgcaggggtgtcctgagtccttccaaaagagaatgctgcagtgccgacagaaatgcagtgtgtctccgtactgctccttcgctgggtaatgtttctgaagtgcaaagtacatcaacttccattcaatatgacctttttctgaaaggatcaaatgtctacaaaactgcttttcagcaaaatggtactgacaaagcttcttccacagctgtctgtcttcactaagcatatacaacgtgggggtcacctggcctaaggtgatgatgtcccatccgtctgagaaccggtataggatgttgttcagcatgtgcagaggaaggtcactgagggtgaggccattgttcacttgcttagtcatctgaagatcctgtagctgttgttgccaggcgagaatagtttctaatcggcaaatccaaatattgatgtttcccactaatacagacttccctactcctctaataagaatgcagagggtagagcttaggtcttgcagaagatctttgattaagcgaggattgtggtggtcatcaagaaccttttgaacgattttatccaaaatgttgaagtaattcttctgtgccacgccactcaatgaagttaactgggattttgcaattagctgcaacagtttgaccacataattgaacnttcggatatcttgaattgcacttgagaagtctaaccgattaaaggcttctcccanggngcaatagccatgcctntngnntatnngtgtcatttctaaaatggtcctttttcctntttttcgatgcatattcatgctcttcattattgaatatttctccatcttcactatttaagataatgctgtgactgatgttacaacggttattctctctttcaagtttctgactacaagattcacatctcttccagccatcttctgtcttaatccaactccatccaggagatctccagtcctgacccaaaaatggcatagttctcctngcgcgcctgcggcccccagtcttcacctgacgcgcccgcgtcccccnnngnnnaannnnnnnnncggccacctgggcccgcacctgacggcgaccaggcggttattgccggaagtgggccgccgcctcccggcgcgcctcagggaagccccgcccctggccatgctgattggccggcgcggatccgcgtggcaatgttgctgcctggtcctgtcgcccgcagcgtgcgcct

SEQ ID NO: 485 - DNA, 2195 bp, Homo sapiens
  modified_base (9)..(14): a, c, g, or t
  modified_base (16)..(16): a, c, g, or t
  modified_base (440)..(450): a, c, g, or t
  modified_base (1034)..(1034): a, c, g, or t
  modified_base (1453)..(1453): a, c, g, or t
  modified_base (1661)..(1661): a, c, g, or t
  modified_base (1798)..(1798): a, c, g, or t
ttttttttnnnnnntnataaatggagtttttctttattatatcatatttctaaatcaaggaagctgaaattatatacttaaatatactctggtcaaaatatacatgaaccacaaatattaacttctacctaccaacaatttacagttatgttgtatgtggaatttcattcttgtcagaactcacaatggaaataaaatttctattatgggtgagaagatgagggaaagaattaaggggaaaaaatttggacagcacacacttttctttcattccaaaggtgccagtcagaacacagatccatggagttccacatctagccccaggctaccaagcattaattcaatgtaaatggtgtcactacaacatcaaaaagagcagtgctaggcagaggattttgtataaaatcatctaaaactctgaaaaactacaaaagcatctnnnnnnnnnnnttaggtaaaagcaatggagtttatttcagtgaaattattttaaattagatatgatatattaagctcccatatgccccaacctggtagaaaagttcctctcagtgagaaatcatttattttaatggcaaaatttttacatatcagtaaaatctgttatacttaaaactatgtatacagtacatttctggcaaaaaaccttatacatctttcagttgtcaagacaaagtaaaaatatggttgcataaagtcacaaaaaatataaactgctgaaaagataataaaaaaagattaaaaatcatttgcattgcctcccttacctcttcaatattagtaacaatttgcaaacaacaaaaaaattgtgaaaattctgttgcaaccttgacacacttaaccaaaggttgtcatttcaaatatcctagcttaaaaaagaatttactgcaattgtctgtgcatttatcatactatttatagaagtgcaatatttaaatattttcaaaataaaacacagtaactaaaatgaatcacaataacttataagagaagcaaagtttacaaaattaacaatttttaaaaggtcctatttnaattggttcctccttttcttcccccctccccacaacagcgtatatagcgccattacttaattccatatacaaatttgtaactttaaaaatacagtcttctgttaacatcaggaacattatgctgcacttagagaccctaagtaaaattagaatcccctaaagagagggccacataaaaagtaaatacagttttgaactcatatttaaatggaacttctattactttgtacagctttcaaattagaagttgaatagaacaagccctggacaaaaagcagcaagatttttcttttgaattcagtgcatgattctagaagtgcttgagtcaaatctactagagtcaccatttatgcaagctatcatgacatttgagttcattatcatctggttacataagtgctcactgtatttgccaaaantaatcctaaaatatgattcttaaaatagaaaaaatatagctctgttgcaatgggaaaatgattaatacaaaaaaatcaatttcttaaagttaacataaggcaaatataaatgatacaatattatcatacacgataccaattttatctgaggtgactacatcttcatttacatctattgtgtgatgcaattaagaatgacaaaaaaaantatcagtgtaaatcagaaatcttaggaaaatccagtatctttaaaaagtaatttaagcccaaaacaaatgtgaccacttattaatagaattgatttgttccatattttatcaaaataataataatgttatatccaantaaagagttataaccaagtgtcatatgtaaactttaattggatcctagtttgaaataatcagctataaagaaatttggagttaacttcagaaatttaaatatggcttgattagatgatattggggaattattacttttacaatggtattacggatttttaggagaatgtcattatctgtaggagatacttgaagtattttcacggtgataagtatgtctgtaacatccaaatggttcagggggaaaaaagcatatatacatacacaaacaaacacatatatgcatatatatgcataactagctgtatctatacatatataggtatagagaaaacaaatgacaaaacattaacaactgctgaatctaaatggtagatatacatggactcaggtggtgt

SEQ ID NO: 486 - DNA, 2254 bp, Homo sapiens
  modified_base (175)..(178): a, c, g, or t
  modified_base (183)..(186): a, c, g, or t
  modified_base (415)..(417): a, c, g, or t
  modified_base (420)..(421): a, c, g, or t
  modified_base (424)..(427): a, c, g, or t
  modified_base (429)..(431): a, c, g, or t
  modified_base (433)..(436): a, c, g, or t
  modified_base (438)..(440): a, c, g, or t
  modified_base (442)..(442): a, c, g, or t
  modified_base (444)..(444): a, c, g, or t
  modified_base (454)..(454): a, c, g, or t
  modified_base (497)..(497): a, c, g, or t
  modified_base (589)..(593): a, c, g, or t
  modified_base (596)..(604): a, c, g, or t
  modified_base (606)..(608): a, c, g, or t
  modified_base (1086)..(1087): a, c, g, or t
  modified_base (1107)..(1107): a, c, g, or t
  modified_base (1372)..(1372): a, c, g, or t
  modified_base (1443)..(1443): a, c, g, or t
gcacaggacatctggagcatctttgaatgggccattactctgggcatcacagggaataaacaggaaaaccagacacaggaactccacagtcattcagccactttgtacagggacaaatatttcactctactggaatagtcccagggctggggagtcggggttagggtgctggacnnnncatannnntgcccaggaatagactgacagtctgaatcaagatgaggtttaaagcctcttttggtaagaggctggagggttcccaaaagcatttttaaaaggctgttacaaaaatacggacctcttactacaggaaatttcatttacctggaaaattgtacagtgagcctcactacctggcaatgctacaatttaacttaactgaatggttacctcatctacttaacattcatagctnnnttnnttnnnntnnntnnnntnnntntnttaaataaanaaatttttatttaagaactgaaaaagacttttttgaagttaanattttagaaatatttaagcgtttatcataaacattcacatacatttatctctgtaaagtggcccaagaacagttatttcccttatttagaannnnnttnnnnnnnnntnnntaattaaactttgattttattatgtacatggatactattaaaaaggtgaattcgtgaaattttaagattgtgtataacacataaaagtcaaacttctaatttggtaagtaaataatcctaaacttaacacagtggttctttaaaatgtttaaatatttgtcttagatgctgaatatagacaaagagaactgtcatcttaggagtaaacacactataactctgtaaaaagaaatcatagaaaagtaaggtagtatttctcaaataagtcctcccatgctaaaaccacagtgacgcgcagacactagcctagaacctattccagtactgcaagtactgacaggctgcaaacaccagtaacaacctgcctggagccttgaccttgaaaacaaatggctgttgtgaactgatgtgaccaaaccaagagatggttccttacaaaaacaaagcaaaacacaagatgaaaatcaagcagaaaaannaaataatataaccttatttntgagaacacgacttcatctcaaaggatactttttgtatattaatcctcacagattaataagagcagttaaaataattttgtgtagatccagaatacaacaggtgactaagttaatgactaacacaatttacagacttcaaaatgataatactgaattccaaatttcacagcataacagatgactataatatactaccctaatcaactcttatttagtgtctatacagcatctacagagctcttcatccatcatatttctcctctnagactttctgtgttcatgactcattttcatccatttctgtcggagaactgctttgggaggagcagagcgantaagtgccatactccggtatgggcctgtgtggtggccagttgttttcttgcaagagtgatcttggagataaaataaattgagtctcaaaaaattccaatgactcgccatcttccttctccatcagaaactgatactctccgaatctgaccatgcacctgtatggcaggtccattttatttaggtagcccagctctctgctgtccacgatcagattggtctttttactcatattttttatttcaaaggagagaactgagctgttgaattttttaaacagctgcagagaaaactgaactcgggaaacctgtttgtcctgaaaagtataatgacagatgttggaatttcggccaaatttcaccacttcgctggaagggagtttctctctgttaaaacttattgactgaaatattccacactgcaactggccaggatggtaaaccgtcatctggagacaagttactgtctcttctgtgtcagcatcttcaaaactggtcatgatgtgcacaaggcccacctggggctggggagtcagtgaactctcttcagctgttcggctctcccggctcagagcgaggggaatcgaggagactgggcgcaggatgggggtggacacccggccgctgctcctccgcgcgggtaagtgtgagccccggggtgcggggaaccgagccagggaccagtgaccgcgagccgccgatcctcccgcgctcccgcgcgcgcggcctgccttcccactggctggcagagcacgtcctctcgcgcccggggcctttgtaaagagcgcagcggtggcgcggaggttttcaggcc

SEQ ID NO: 487 - DNA, 1846 bp, Homo sapiens
  modified_base (65)..(65): a, c, g, or t
  modified_base (566)..(566): a, c, g, or t
  modified_base (574)..(574): a, c, g, or t
  modified_base (591)..(591): a, c, g, or t
  modified_base (909)..(909): a, c, g, or t
  modified_base (1247)..(1247): a, c, g, or t
  modified_base (1417)..(1417): a, c, g, or t
  modified_base (1420)..(1420): a, c, g, or t
  modified_base (1456)..(1456): a, c, g, or t
  modified_base (1479)..(1479): a, c, g, or t
  modified_base (1525)..(1525): a, c, g, or t
  modified_base (1543)..(1543): a, c, g, or t
  modified_base (1557)..(1557): a, c, g, or t
  modified_base (1626)..(1626): a, c, g, or t
ttttcaaaaagaaaaaatttcactttaatccagcctcacccccacatgtgtgtttcacacagacnttattttttaaacagagtttattgtatttaatacattataaaatttgaaaaattgtaggaaagcagcagacttgaactggagcaattctaacaaggaataattctggccccttggcaaaactgatcagttttaaaacaaagtaaagttcacatctgtgaggtggacaaaaaagtgtgacttctgtacaaactacatttaaaatttcatgtctaacatctttgcaatgtgctcatgagggtttttctgaagtcctgcctggtccctgcctaaagaaagacgtggaacctccatatacaaacaaacttgattcaaggtgttttgtttgttttgtttttttaaaaaaaaaggaaaaagaaagacaaaggaaaaaagaaatatggatggctgttgttggcaatggaaactgtaaggagactgtgtcctcaccactcatggcttgtttatttgtcagaggcctcgggaggcccaggacacttcacggccatcacagcaccaactgncggctgtnacctttttttttttttnttttttgcatttcctaccttttgacatatatatatatatttatatattttttacaccttgaggatatcactattccaattgttcccatatgaatacaggtgtggtctctattggatataaatgtgtcttttattcgattttacgtccaggacttggtttgctgtcccaactgcacataaatgtcccttttttgtttgagttattggttgtgtgtgttttcctttttgcataagaaatatgtccatttagtccagaggctcttgctttatccggatgacggagggtacacggggcgtccgcctcagttcccgccgaagnacgtattcgctgaactgggacgagtctactcctcccccacaggagcccacgatttcaaatcctctttgctgcaacctctcgaggacctggactgagttgaggtgacagtagccatttagtggaaacctgatgacgtgcgtcgagtcgtgattccagcctgcattgacagagttacacatcacgtcgccgatctctggaaatacttcttctatcaaggatttgtcaccgcttagcgtgatcctttctccgaggtctggggccacacgcacgacgaggcactcacagggccttgaaaatcgaccagtttctctgtcctgcttccatctttccatctccancaacatgggctgaagctgaaaatattttgcctcttcatataacaaagtgtagtccttgaaatcatcaggaatgaggagtttggatgttcgtagaaaattcaagatatatctgaacatctgtccatctctgtcaatgaaatagtgctgtttgagactgtccaaaacaatgngcnctgtaccatcaaaaagtcttccgattctggattcanggtatttggtgagggtggccagnctgctggtgtacatgtggccgcccacatcaatgtggacaggcgcantggattttgtgagttgtnctggagtagggatnccttggttgttcagtggagatgcaggggatctagtgatcagaggtcttgacatattgggccgactgtcntttggtgatggatttgcctttattcatctgcaccctccatcccagttggtgtgcagtgcaggcttgaggagaaaaagctagtgacgggagctgtagtcccagctactggtgaggcaggtggtggctcgtgccgaattcctgcagcccgggggatccactagttctagagcggccgccaccgcggtggagctccagcttttgttccctttagtgagggtta

SEQ ID NO: 488 - DNA, 1100 bp, Homo sapiens
  modified_base (24)..(28): a, c, g, or t
  modified_base (288)..(288): a, c, g, or t
  modified_base (984)..(984): a, c, g, or t
  modified_base (1030)..(1030): a, c, g, or t
tttttttttttttttttttttttnnnnntttgataaatgtaatttttttttttttaaagaaaacacagaacaagtcctaaatcagacaaattgcacaaaagagagagaagaaaattgtaagcttcctgggagaggaagagatgtccatgagaaaaccaactgggatgagcctacaaaagcatgtccctctctctcctaatttacttagtctcaactgagcccaacaggagctggcctctgtcccagctgcaggatgctcccaaggcagtgtccaagagcctggaaggnagcttttatcagcaggttcagtacagcaggaaaagccatcctggcaaagagtccagtggtcctattagcgtaggctgctgctgctgctggcctgggagctgcccatacctgggtggtctggactatgtcgattcttctttttcttcttctctttcttcttccttttccgttcaggatcctcttcttttttctttttcttcttcttgtgatctgaatcagatggtgtttctggggggacaggatcctgggtacggctctgtttgtgcttgtgcttattcttcttcttgggaggctgaatatgcatcagacgacactgctccggcaacgggccagtgtggaggcggaagccggccagcatggtccctgtgataggattgaaagagctactgagaatagggggcttctcaatgagagagcggaggctgctgttatcatgggaaccaggcagatcaatcatccctggcaggtcaggcaggaagttacttagcttctccttcaccttcttcccacagaatttattataggcttgttccaagttgtagtgtgtgatcagattcgtgctgcctgtcagctctgtgctacctggcagttccctcatgaggtaaaaagggccacagccagctcctgacttgtccgcgccaggaggagccgtggccgcggtgggaggcggggccgtgccgggtcccccgcccgcanggaggcggtggcgggggtggaggctttcctggtccgaagccgagtncggttgggggcggtggtgggtcagcctgagccccaaacagtgccgtgaaattctccatcgtaccctccgc

SEQ ID NO: 489 - DNA, 1880 bp, Homo sapiens
  modified_base (89)..(89): a, c, g, or t
  modified_base (93)..(93): a, c, g, or t
  modified_base (96)..(99): a, c, g, or t
  modified_base (102)..(103): a, c, g, or t
  modified_base (106)..(106): a, c, g, or t
  modified_base (109)..(111): a, c, g, or t
  modified_base (115)..(117): a, c, g, or t
  modified_base (121)..(121): a, c, g, or t
  modified_base (124)..(125): a, c, g, or t
  modified_base (131)..(133): a, c, g, or t
  modified_base (136)..(136): a, c, g, or t
  modified_base (141)..(141): a, c, g, or t
  modified_base (145)..(146): a, c, g, or t
  modified_base (241)..(241): a, c, g, or t
  modified_base (738)..(738): a, c, g, or t
  modified_base (784)..(784): a, c, g, or t
  modified_base (910)..(910): a, c, g, or t
  modified_base (1553)..(1553): a, c, g, or t
  modified_base (1557)..(1557): a, c, g, or t
  modified_base (1559)..(1559): a, c, g, or t
  modified_base (1575)..(1575): a, c, g, or t
  modified_base (1582)..(1582): a, c, g, or t
  modified_base (1586)..(1586): a, c, g, or t
  modified_base (1595)..(1595): a, c, g, or t
  modified_base (1616)..(1616): a, c, g, or t
  modified_base (1645)..(1645): a, c, g, or t
  modified_base (1660)..(1660): a, c, g, or t
  modified_base (1678)..(1678): a, c, g, or t
gtggagatgaggtctcagtatgttcccaggctagtgttgaactcctgagctcaagaaatcctcctgcctgagtctctgaaagtgctggnattncannnntgnnccncannnacannncctnttnncacaannnttnacaancaanntatattttctaaaactatccagatttcattatcagggaaaagtttgcttaggtttattacagcagtcctttgcatttgtatggtaatttgtactntacaaatactttgatatattataactctattggtctttgaaacaaagcgatacagtgtaggtggtatcattctctttctcactcagtgtggcccagagttgctcagaattggagcagagcctgagacgtatctgcagatcctgtcatcagctggcaagtccaggagactgtgtcatttagagactgtgttgttagttatccctcaacatcttctaaggtggcaggaaataatattggaaataacattttaaagtaaaaattttaaagtttaaagaagagttttgccacttaaacaggggagctttgtctggaaaatacactgagttgaaacacttcatccttggaaggattatataagatgaacagttgtgataaatgtgtagattagagggatgtgaatgggcagttagtccagtgccctcatttaagaggccaagatcctgattcagaggaggcatcctttgcccagagctgcttagctaatctgaccaaatgtngggaaaaatgtctcacctaacccactattccttaattatggatttngtgaaaaacaatagaacatgttaatgagtaatttatattagttcgatgtattacaattttttagctttaaattacagttttcttataatgttgaaatgttttagaatcctttgaatctaagtattngtttcctaaatgaaacatttgtacaacatttgatgtttttacttatgaaatattctcctcccccaagaaaatttaaactttttctctctatttaaaagctaagaaatgttttaaaggaaaaatgaaattatcttcctttagcttatttttaaggtaaaacagctttttactctgttattgtggtaatggacagaatattacatacaaaaatattctgggagagctttttcctagttggttttaaatcattgtgccacctgaaaggtttttagattttataggagctaatttgtccaccagcattaatgtaacacagtgtagttatgaaaatatattgaaggacaggaagtggacacgaagtgatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactgagtcaatttagccttttaaaaatatagtcnatcncnttttaaatagaatccntcttccnaccnatcaaggcntcaacattttgtaagcatccnaaaaaattggtaattagggggcttgcacntaaatttcactatcnttcagtagagaggaactntttggaacttagatttccaatgtgtatattctaatggagaaagcaagaggtagagtttgtatgtttgacttaccttagatttttattttccatacatactgcaaatgattgacttgttgcataaatgaagatcttctgttgtgtgcttttcaaacactgtaaataaatttgaaatttgaataactttccacagtataactgt

SEQ ID NO: 490 - DNA, 2154 bp, Homo sapiens
  modified_base (557)..(557): a, c, g, or t
  modified_base (779)..(779): a, c, g, or t
  modified_base (839)..(839): a, c, g, or t
  modified_base (879)..(879): a, c, g, or t
  modified_base (908)..(908): a, c, g, or t
  modified_base (944)..(945): a, c, g, or t
  modified_base (1742)..(1742): a, c, g, or t
  modified_base (1749)..(1749): a, c, g, or t
tttttttttttttttttttttttttttaaacataaaatgctggtacacatttattcttttattgctaaacatcaaatgccggcaattacgataccttcaagttaaagcttaagaatgaattacaggacagtcagaagatttatagaaaaaaacacctgtgcaccattagtatgtgaacattcaataaataccataggacaaagtgatgactgagagccacaatatctatgaagcacatgtttacaatttgctgttagaacagacaatgacctgtaagagcgattatcaaaaggtcaagtttaactgcatgtcttttcaaactgagatgctgaaaagaatatatacattctttacagattgtaggtgattaaaaaaaactgtcaaaaatgtaaacaatgcagagtaggaacactgagaataaagttttactgttgaacaaagtgacaacgcagaaagaacactttcttcaatcctcaaaataatccatttttccaatcactctacagaaaccacagtggattctttccatgaagatgataatatgccagggacacaangaccctccaagttatttttttatgtgaacatatatttacagtaaatattcaataatactttttacagcttacttaaatagaaacatgctttttctaatccataaataacactaatcattatccattcaactgcatttattaagtacttatgtctcatgcactgtgccagggatgcaaagatgaatatgatatggtccttgctgtagaagtgcccacaaccangctaaagaagaaaacacgtaacattttctttcttacataatgaggccggttttatacaantggtactgatctgctctttcctagtaaagtggttcccaantcctgatcctatgggtcaacagatcaaantgtttaacagttgaaataaaatgagatttgggtttnntttttttactcagaaaaataaattaatgaataagatttcctctattaaagttttttcttggtttttaaaaaagtgacttgcacatatacaaccttttcattagtaaaattgcttagttcatgcaatcaaattaattatataagtatttcatggcattctccaagctctactacttgaacaggtctgactgagcattactatgctaatgtactctgatcccaaatgattgtctacctaaaaatagaacaaatactgtattttctggaataaaccaataattcgtatggttttagtactggtattaactgatgacccaagtcattaataaaatgttaaaattatattcaacatctaattactgttaaggcaaatttgtaatacaatctaaaaagtttcttaaaaatgattaaaaagttttagtgcttacagagcaactcaataatctgaaaaaggtaaccccatggaatacatcactcagtaaagaagttggatagatggctattaatgagttattgcccttagtcacttctgagtatacaagagaagcatgtattttccatcaaagaaacagcaagctcatatactcctaggaccaatagcttcacactggcctgctgactccccaaatttcccagggctgcatctccactccaaaagacctcaaagcaggcgtggctcttctgggctcaagaatcagttcccaagccctggaaaatccatgtttgtactcacgtatagccattctcactatactaccaagtcttctgtggacccagagaggtagcttaggagagagncagaaancaaggactaggtacttaataacctgacacagaaaaacatgggagccgctggtgaggacagagtatggctcagagtttaaggtcattgcttcttggagacaggaacccaggagctaggccccagatgtcctgagcagctcaagagaaaatgtttaccctggaagggttccaagcttcaaagctctatagagaatgggaagtaggactgctgaagatcctctggggtgtcttgtgatctgtcaggagacccggcctagttccgaagttcaaccccaactgcctccctctgctcacatgctgctggtgtgtgatgcttcctgcagctcaccgtggatgtcaaagctagtgctgctttatgagggggcagagactccttataaaagatgcaactcttgtggggcaaaac

SEQ ID NO: 491 - DNA, 819 bp, Homo sapiens
  modified_base (90)..(104): a, c, g, or t
  modified_base (107)..(107): a, c, g, or t
  modified_base (112)..(112): a, c, g, or t
  modified_base (114)..(114): a, c, g, or t
  modified_base (120)..(126): a, c, g, or t
  modified_base (179)..(179): a, c, g, or t
  modified_base (329)..(329): a, c, g, or t
  modified_base (657)..(657): a, c, g, or t
  modified_base (663)..(663): a, c, g, or t
gaggcccccccacctcgcccggctcacacccccaaagggagggacccacattgcacacactgtaagaaatgcactttccgaggaaggggnnnnnnnnnnnnnnnatnggggngnccggannnnnnnagcttctcagccagggtgggggtcgtggagtgggggagggaggccagccgggnctccagaggggtcagggcgcgacgagaaccaactctttacctaactttgcatggtgcttagtcaaggactcctgcgacctggctcccgaggtcagctggcggcgctgacacacatgcatggcagactatccctggctctatctccctgtncctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatctaaaaaaaaaaaaaaaaanaaaaanggagagaaaacaccacgctaaagattcagacgccactggagaagacatttggcgccccaggtctacgccagcccctgggtgtcctgggtcctgggttcccctcctggtggttattcagggggtggccccctgggtggctcagctttaccacgcccc

SEQ ID NO: 492 - DNA, 1344 bp, Homo sapiens
  modified_base (67)..(78): a, c, g, or t
  modified_base (80)..(80): a, c, g, or t
  modified_base (82)..(82): a, c, g, or t
  modified_base (84)..(84): a, c, g, or t
  modified_base (86)..(90): a, c, g, or t
  modified_base (92)..(93): a, c, g, or t
  modified_base (95)..(97): a, c, g, or t
  modified_base (99)..(100): a, c, g, or t
  modified_base (103)..(106): a, c, g, or t
  modified_base (288)..(288): a, c, g, or t
  modified_base (611)..(611): a, c, g, or t
  modified_base (872)..(872): a, c, g, or t
  modified_base (882)..(883): a, c, g, or t
  modified_base (885)..(891): a, c, g, or t
  modified_base (893)..(893): a, c, g, or t
  modified_base (1022)..(1026): a, c, g, or t
  modified_base (1215)..(1215): a, c, g, or t
  modified_base (1282)..(1282): a, c, g, or t
  modified_base (1306)..(1306): a, c, g, or t
tttttttttttccaagagatttacttcatctttattaacagtaccatagtattccactgtctagtannnnnnnnnnnntntntntnnnnntnntnnntnnttnnnnttgtttcaaatcttttattattagaaaagtgctgccagaaacatccttgccatgcttctgtatgtactggtgctagtgtttctatcagataaatttttagacatgaagtgaattactaggcataggaaatataatttacacttttgatagatactgagtttttgctcatttgctacatgaancagaggcagagtattctgtgtggggtttgggacaggaacactgacccctgaagtcgagcctgggggtctaacatagtggtcatttgtccagcctgttttatggaaggaactggactctgagctttggggaatttcctgcaagataaatgtatatcccacctatactggtaacaggtaagttatgcacaaagatgaaaagacaaagccctagctagatcagctcttgctctcagcactacaatggccagcggtaattctttcagttaaaatgacaattaatacagtttcattgaagcttcaaacagagcagccagatcctcttntgactggggacggggtgcaagcttggtgaccctttcctggggcagcgttcctttcactagtgcggggatatcagctttggagtaaccaacagctgctaggccatcatcaacatccagatcgaataagaatttccggagcgtgtctgccaacaccagccctgcatcttggatcctggcagtgcgggtgtcggctcccagtatttctgccatctccaggtgtcgctctggaaacatctgggccgtgaaagtgaacaccgctgnggacgtgagnncnnnnnnnangccatggggctggggagaaacgaaatgcggtgaccggcagatgacaaagctgttcttccctgcatattctagatgttaagttactttaccccatactctaagcaggcgagaattggcaaatatatttannnnnccagtgggtgatccacattgtaatcctttgctttatacatcttcactaaacctgaaattgggtaagacattccatggctagaaaagaaagaaaatccttatgttcatacacagttatcaaaattcaagtcaacaatagaaagatactcttatggggatgcctgtcacggcctctagacagtatcattanctgaaaaagtgatatgttctgttttcttggatataaggatatattatgatgtctagggacatgtagntgcattcattaacaaaacctctgnaaaatgctcaaattcaaatggctcataggaattgtatg

SEQ ID NO: 493 - DNA, 2032 bp, Homo sapiens
  modified_base (143)..(143): a, c, g, or t
  modified_base (675)..(675): a, c, g, or t
  modified_base (736)..(736): a, c, g, or t
  modified_base (748)..(748): a, c, g, or t
  modified_base (750)..(751): a, c, g, or t
  modified_base (754)..(755): a, c, g, or t
  modified_base (771)..(773): a, c, g, or t
  modified_base (775)..(778): a, c, g, or t
  modified_base (780)..(781): a, c, g, or t
  modified_base (784)..(784): a, c, g, or t
  modified_base (786)..(791): a, c, g, or t
  modified_base (794)..(794): a, c, g, or t
  modified_base (796)..(798): a, c, g, or t
  modified_base (1060)..(1060): a, c, g, or t
  modified_base (1167)..(1167): a, c, g, or t
  modified_base (1177)..(1177): a, c, g, or t
  modified_base (1197)..(1197): a, c, g, or t
  modified_base (1248)..(1248): a, c, g, or t
  modified_base (1252)..(1252): a, c, g, or t
  modified_base (1291)..(1291): a, c, g, or t
  modified_base (1702)..(1702): a, c, g, or t
  modified_base (1707)..(1707): a, c, g, or t
  modified_base (1721)..(1721): a, c, g, or t
tttttttttttctttttttttttttttttttttttttttttttttttttagttatcatacatttatttttaacatagcaccccagtttcacatcatgtatattttccaaagttggagatctttaactatgttcttcacagacntttcaacaagtgtgaaaaagaggcagtaaggttagcttgagtctacaagtcacaatccaaatataggacacctatgtttaaggtcaatatacataatgttcccaatgcttagcaaatgaatgagactctggctgagtaaaatattaacacaacttgttagcacattatcatgaaaagacagaaggcatcaaatatatactttgctgttacactttttactgttcaatgtacttgtagtgaaaaaatatacatttttactttcaaggttaaaatagaccatcagctcattatctctcttagccaatagctatgaagactaaaatggctcttcttgcttctggctcacttgaacatcttatttgtgctgaagacaaaaaggatagcagtgctaaagaaaagggtatacccggttcccaagataggtgcggttgaggttctcgcacaaggtgacttaaaacaaaaataacacaactcagttgatccaatctccacacaatggggttgcataatcaactgttccagccccagagangagctccctgaaagagctttaggatctggccctgttgttcaacagagggcttcaggatggnactggtatctgnannttnntttactgtagtttccnnntnnnnanntangnnnnnntanannntggtgtctgctggtcttcagagtcataaacccacttctctaatatcccacagccatgacattagcttacagcaagaccagagtattcacaaaacatgaaaaaatgagcatttcccaattgttgacagcagagcaaggcttctgtaactagaacatgtcctgtgtattgaaaccctgcaatgcctcctagaaaaggttcctttatcatcatgtgtgttggcatgtgtagaaaataactatacaagcctaaaagcaactgtgtncttcagatgtcttgctcatactaacagactgactgctttagggcatgcatgtaacacagcctccaaaagccttttttagaagagggcaacagctcttcgaatctgcnttgcgttgcnttttaaagtctggccctccnatgtctgctgctctcgggaaattcacataaccagatgcatttctccttacnaacnagcgaagcagggtggctcacagagtaatacccacattcnaattgccatcaatgactgacctatcagtgttggtaggatctcccctagcttgtgctgaaggaggaacaagacatgtgagctgaggactccaaaaacacaaatccccacttcttactaggaaattgaaccatactgagtcatgatacaaaaaaaaaaaaagtaacaaaacacccataactaaagtataaattcaactgatcctttgaaatcagagttttaaaagaatacccttgaaacagtaaagcagttagaaagaaaaaccagaattactagtgttctctttaaacacagtgggaaaacacctcttaactactatttcattttgttcacattcagaatgttcaaaccagaacctaatgatccctacttgtcaataatatgggaagctctggttgccatgatacgttatantgttntctttttatttttnaaaccacattcccttggtgatatctagtgagaaggtgtgattctagtttgtgttgaacaaatgtttttagctctaaggtgttacactgtaattgagatgtttccaactactgcttaaaagaagacattggcaaatgcctgccttaattgcaaaaaacacatgaattccaatattaccttattgatcttctgagtacacatctattattaccatggctgtgagatcatttaagaaacagacaaatgtcatttagaaacagactatagaatcaaatcacaactaaagagaatgctttatgatagctcagacag

SEQ ID NO: 494 - DNA, 1936 bp, Homo sapiens; identical to SEQ ID NO: 255
  modified_base (27)..(27): a, c, g, or t
  modified_base (220)..(220): a, c, g, or t
  modified_base (237)..(237): a, c, g, or t
  modified_base (253)..(253): a, c, g, or t
  modified_base (292)..(292): a, c, g, or t
  modified_base (300)..(300): a, c, g, or t
  modified_base (312)..(312): a, c, g, or t
  modified_base (329)..(329): a, c, g, or t
  modified_base (340)..(340): a, c, g, or t
  modified_base (342)..(342): a, c, g, or t
  modified_base (367)..(367): a, c, g, or t
  modified_base (740)..(740): a, c, g, or t
  modified_base (1223)..(1223): a, c, g, or t
  modified_base (1230)..(1230): a, c, g, or t
  modified_base (1234)..(1234): a, c, g, or t
  modified_base (1239)..(1240): a, c, g, or t
  modified_base (1242)..(1257): a, c, g, or t
  modified_base (1259)..(1263): a, c, g, or t
  modified_base (1265)..(1267): a, c, g, or t
  modified_base (1269)..(1274): a, c, g, or t
  modified_base (1277)..(1278): a, c, g, or t
  modified_base (1280)..(1280): a, c, g, or t
  modified_base (1290)..(1290): a, c, g, or t
  modified_base (1301)..(1301): a, c, g, or t
  modified_base (1305)..(1305): a, c, g, or t
  modified_base (1309)..(1309): a, c, g, or t
  modified_base (1316)..(1316): a, c, g, or t
  modified_base (1319)..(1319): a, c, g, or t
  modified_base (1321)..(1321): a, c, g, or t
  modified_base (1343)..(1343): a, c, g, or t
  modified_base (1348)..(1348): a, c, g, or t
  modified_base (1350)..(1350): a, c, g, or t
  modified_base (1359)..(1359): a, c, g, or t
  modified_base (1364)..(1364): a, c, g, or t
  modified_base (1370)..(1371): a, c, g, or t
  modified_base (1376)..(1376): a, c, g, or t
  modified_base (1883)..(1883): a, c, g, or t

SEQ ID NO: 495 - DNA, 1005 bp, Homo sapiens
  modified_base (84)..(84): a, c, g, or t
  modified_base (86)..(86): a, c, g, or t
  modified_base (88)..(93): a, c, g, or t
  modified_base (96)..(96): a, c, g, or t
  modified_base (109)..(109): a, c, g, or t
  modified_base (113)..(113): a, c, g, or t
  modified_base (952)..(952): a, c, g, or t
  modified_base (955)..(955): a, c, g, or t
  modified_base (958)..(958): a, c, g, or t
  modified_base (960)..(961): a, c, g, or t
  modified_base (963)..(965): a, c, g, or t
  modified_base (967)..(971): a, c, g, or t
  modified_base (990)..(991): a, c, g, or t
  modified_base (993)..(997): a, c, g, or t
  modified_base (1005)..(1005): a, c, g, or t
ctgctgcgacagccacgatagtcacttgctcatctgaaaatgccttgcactttcgttttcactagcttcgtgtatgacgcaaancngnnnnnnttnttttttttttttntaanagtaagaaaaatatacaactatatttaaaatacttaaattaacaagatagtacttttccattctaacaaaatatcatacattcagtttaaacaagagttaatatccagacacacgttttcaaaatacctgatgctagttgaaaattagtgaccatgaggctttccaagatatttctaattagcaaactgtgtacaattttgaagaagtgtacacaccgtgctggaagacagacactgaacaggtcaaaatgcaaactcatgtatctttcatcaacctaaatcttgttgcttcacttttctaaatgatactttggctgtcagcgaatcttatagcttcttttcccttaaagacaataatatataacaacaccaccccacacaaataaccataaacttctttgtgtgaaataagccctatcaaaatgtgttcatgtatttctgtaccaactgatctatactgagactgtcatgaaaaaggtatcaaacaagtgtaacaggcctacacttaaacctctgcctcaaaggagaaatcagatacttgccacgttattgcaaagtcaaagctgctacacttaaaatatggtagatagtttagaaaaatcaaatcaaaaatgttttctcactggctttttcagataaagaagttggaccacaaaccaacacatctgtgtgaaaacagccaccaatttgagtccccccagcccctcaaaaaggaacaatgccaccagtccctcacaatgaccataacgtctctggccaggactgcgatttctagcgcgtgtcttcacattctatctctggggaagcaagacaaacaggctctacccatttccctcctnttntcncnncnnncnnnnncctaagatcctctgaattnncnnnnngccgaaan

SEQ ID NO: 496 - DNA, 1784 bp, Homo sapiens
  modified_base (6)..(11): a, c, g, or t
  modified_base (295)..(296): a, c, g, or t
  modified_base (605)..(605): a, c, g, or t
  modified_base (656)..(656): a, c, g, or t
  modified_base (849)..(849): a, c, g, or t
  modified_base (930)..(930): a, c, g, or t
  modified_base (1007)..(1007): a, c, g, or t
  modified_base (1058)..(1058): a, c, g, or t
  modified_base (1185)..(1185): a, c, g, or t
  modified_base (1267)..(1267): a, c, g, or t
  modified_base (1317)..(1317): a, c, g, or t
  modified_base (1413)..(1414): a, c, g, or t
  modified_base (1595)..(1596): a, c, g, or t
  modified_base (1599)..(1599): a, c, g, or t
  modified_base (1601)..(1601): a, c, g, or t
  modified_base (1603)..(1603): a, c, g, or t
  modified_base (1607)..(1607): a, c, g, or t
agcggnnnnnnttttttttttttttttttttttgttaaaatatcttttaattttaccggcaaaatacatcaatgactaatatattcccgtatggaatatattcttattggaatatattcttatatagaatatatagactatgtatatatacatatgtgtatatacctatatacatatatatatcttggagatataaaactaattgggaataatgtcatatatatagatagtaagcaaacattttttaaaacattttaaagactccaaactattcatttctatccacctataaaannctagcaattaaacctgtcaaatcacagccatcttgctttacgcagattcagaaacatgagatccttttacctttgaaactctagtttcaaagctgttctaaagtgacttggttttaatttatatacttgcagggataagaagtagctgtagggccataaaaatgtaaagaatacagtatcgtgcccatacacaactgcaaacacttatttttaagtgttcgtaaaagatagtggtcttcagaaacaccccttttcagattggcaaactttcagagttcaaaagtgcatgtattacacttttatccccancaagctagtagctaccctctaaagcagaggttaacattttctttttccaanccacagaatggattatgatcccatgtgcatactcccatggttcccttccccaagttgtatgaaaaaataaagcaaataattctgaggttttaggggtagtggtatagggatagtattcacacacaaaaaaactgaagtacaaggatatgagacttttgttaaaatatcttttaaagtaattttactggcaaantacataaatgattaaccagttttaaaatagtaaacttatttatttatttatttttgagacggggtttcactctctcaccanggctggagtgcagtggcatgatcttggctcactgcaacctccgcctcctgggttcaagcgattctcctgcctcagcntcccgagtagctgggactacaggcgcacaccaccacacccagctaattttngtatttttagtacagacagggtttcaccatgttggccaggatggtcttgatctcttaattttgtgatctgccagcctcggcctcccaaagtgctgggattacaggtgtgagccaccatgccctgtcnaaaatattaaacttactaatacattgtaatttttagtacttctataattactgcttcataaaaaagtggatttttccagctntccagttcagatgctattaacaggtaatcagatagcactgactaagtagnaatagattaagagtaatacctaaatttaatgtattttagcatattgaaatgagtatcatcagtgtatatttcatttatcactttgtctacactttnntaggtggccttaatgcttgtcattgacaaatgttaactttcctcacaaaacctacactattcacttttttccagtatttttaccttccttattaaaaatgtttctaccatcaagaatttaaaatagaatcatgacattgcaatccaaacactaccttggcttgccagattagtctacgtgnnacncntnggtntaaagctataattccaacttccagcaaagaagtatctctgaatttgacatttctatgggaataaatgtgaactgtctcacatttaaccattaagaatttactcatacgtcatcatgataacctaatgttagactgagaatcactgctctagtgtggctccagaagctgtcagtcagg

SEQ ID NO: 497 - DNA, 706 bp, Homo sapiens
  modified_base (123)..(126): a, c, g, or t
  modified_base (213)..(213): a, c, g, or t
  modified_base (307)..(307): a, c, g, or t
  modified_base (518)..(518): a, c, g, or t
  modified_base (564)..(564): a, c, g, or t
  modified_base (568)..(568): a, c, g, or t
  modified_base (684)..(684): a, c, g, or t
  modified_base (696)..(696): a, c, g, or t
  modified_base (700)..(700): a, c, g, or t
ttttttttttttttttttttttaatttttaataacaatttatttccctttaaaaagatcaaatgtttttctcataatatattattttacaacaacaaagaaaaagaaagagagaaggaaagannnncctgaagagaaagaaataaccagattttagctcaaagagtatagcctgggattaattttttaagatttgtttgtcaatttcaaaaantcagcagtggaataaagagcttaatacaggtatgcaaaaaggaagccctcgagatgttttcaccaggatgaaatgggattagctttgtagttcntataatcttcttcacagaagaatgcaatttcagtttcactggcgattccagctgctttcagagtgctgtcttctttcagcaggagtctttcgtcatcttccaaactcaacacaagttcatttgtctttgatttatgtgcttgatgaataatctttagtgcatcatatttataatttctgaatggtggtggcaggttggtccttaaaggganatcttgctttagaaatacgataaattcctttacagtttggtccaanattnactccgtgatacactacaggtttgaaattgcgatgttcaaaggaacggatgaggcgaactgtgatggtcacttctccaggagccatgtgaagaaattcctgttcccggcgtccccntcggctactccnggcntttgcc

SEQ ID NO: 498 - DNA, 7659 bp, Homo sapiens
  modified_base (518)..(518): a, c, g, or t
  modified_base (656)..(661): a, c, g, or t
  modified_base (1026)..(1026): a, c, g, or t
  modified_base (1102)..(1102): a, c, g, or t
  modified_base (1179)..(1179): a, c, g, or t
  modified_base (1282)..(1282): a, c, g, or t
  modified_base (1342)..(1343): a, c, g, or t
gtatttgttgtgaaatttgtaagcgaataccattttcccacaggaaccagttatgacatgattccgaatttaatacgactcattatagggattttggccctggagcccaagaattcggcacgagggtgggtgtcactacagacatgttctggcgtgttctccgagggatggagcatcctgttatatatttgacttcaaattgagatgttggcttcattttttttttttacccaattaatctcccaatccctagcaactgtgactctgtatttagcacaagagaaagctgagaatgtgggtcttgcctccttccagaaatatgtctggctcatcaggacatttttttaaaacttcaaaatatttttaagatattttaaacttttataaaaaaaaaatcaaccaacaagagacttttctgaggaggaacatttgtatttgaacaagatccttggtgtgtagttcagtcttgcagtatacaagcttttgtgtataaatgttttatgatatgattccctgtnttttgcaggggtttttttctcttttgctttttagataaatatgtatatcaatattttaaattcatctttgctttttttagaggagtttgtaatcaccttataacatgaaaataaacatttcctttttaacatccaaannnnnngggttgtgttctggtgaggtatttccccctcaacgtttgccaaacgctttacattttataaagggcttcccgtccaatcccaggacgctcctcaaaggtaggtattttcccaggttagaggttcccacatggaggctcacagaggaagcagcttgctcactcaggggtacacagcaagtccatgaaagaacctggattcgcacccgggcccatgagctcttggctctactggctctactgattctacctgctacatgcccagccctgtacagctgggagatctggcagcagtcacctgagcctcagtttccccatctggaataaaccattgtccccatcaaggccaccaggatgattggaggtgntgctcttggccttaggtgctcacctgctgcggctttcagtccctcctctttagccttgggctgacctgccagaagngcagaaagcgggtggcggagtgggggaaagggtagagggggagcaaacctgattgcccttctcccactcccccaccntcaggtgcaggcgctcattaatacccagttaggggctctctggggtcacaacaggtccatgtttggggcagccttcctgccaacagcgccccccaccctttgngatggacaaactcgggagtcagttgagccctttgcccaactaaccagacaaaattctcannaactcatttatagacaatgttagaatagaagaccaccctacccccattttctggctctttctgacagcctctgcctacctccctccctctctctatgtgtactggccatgtggcttgtgttcaagccctggttccatcccttactacctgtgtggccttgggcaagttactcaacctctctgtgcctgtttcctcatctgtaatgatgggacaggaatagagcccacctccaaaggctcttgggaggatccagcaagctcttgcaaagcgcttagagcaaggcctgctgcctcccttggccttccccctgcctacaccactcccaagacagagtactcgcttcctggaaagaagctcttcctctgctcacagaactgtggcctccccagtggggcctggccctggcctctgggtcccagaccctgtagctcacctgccctagacactctctggacactccagggcagcagccagacccgaggctgccctcctgccactaccttcccaacctgggctaaagagactccatatgcaggcaccactgcctgcctctggctttctgctgcgcagagaatcaaatttgctccccctacccaagccttcacgactgattcctgctacctccaacctagtctccagccccattcccctcccaggccttctttctcttccttgagaccgtcaaactcgttcctatctcagggcctttgcactagctgtgcccgctgcctgagacactcttcctccaggtctccatggaggctggctcctgtcttcaggtctcattgcaaatgtcgcctcttgagagaaacccctcctaatattgtgagctaaagcccctcaccctggtccctctatcccgttactcccttgttttctttgttgcacttgatgccttttgaaataattatttatttgcttacttgttgattgtctgcctgccaccagaatgtgcagacatgacctaaatctgtctgattcatgttgcccaggggctggatgatggaagcaaatggcaaactttttgaattaatgaatcatcaaaagcaggtgagatgtcaccagacccatacagaagctgactcttgccaatccatgatttttttaaaaagcaaacttctactctaggtggatttaaataattttattttaaaaaatcatccccatggcacctacccccaagccactgcaacccctggtgggacaaagacttagacgagggccccaaacagaccataagcggcctttgcaatacagccccttgtgcttcccgagagccctaagaaaacccgatgtagaaaaatactttacaaggaatgtgttctaatctcagccagagaaaaatacagctttgggggagagggcaggtggaaggggacatgtcacaggggctgttcccaaaatgcataggcaggcagggcgctcactggggaaaggtgtcaggaaatttcaagtcggggatgaaccatccccatgagaagccagaagaaatattgcatatgaggaggccggcatggctgggaggcccaccgcgggcctgattgcatacttttgggagaatggcagaggcctcagcccgaggagggaggggggtattagttagagtcgggtgcatcttccctcgcctggagtcctggagtcaatgcagttttcccaagccgagaggccctgagagtgtgtcctgtccagccctgttgcttagcagaggtccagagaggctgagccacctgtccaaggtcacacagctatggctgcttgcatccagaagccacacctctgctgtgctgtccctcaccctcaaaagtgagggctcttggctttcacttggtgccctgtgacaggtagacagtgccctttcactctgggctgagtacacgggaatccaagatagcagaggcgctgagcaccccaggcacaagcatgcagggccctcagggagggcaccaaggggcagagcccagcgaagtggaggggaggggtaagggaggcaggcctccaggagacagcgtgggcaggtccccaagggggccttggtgggtcggcagagatggttccggccctgaccaggaggcctgtgtctgctcagactgtccacccgtgatcgtccagaggggctgggggtccaacccagacagggtcacacagcaaacaggtaacagacccagggtgaaaagaacagacctcttgactcctcatctgttccctcaaatggaagagcacttttctggcctccagggaccccaggttggagacagatggaggtgggagtgggtgccccgttttcctgagacccctgtgagaactgggccaggcaaagcacatccccagccctggctacacctgcccgcccactccatcccaggcaccactcactagaccaccaggggaggcccacacccttctcaaaatgaagagggtctctgatttgtggacactgaggacaatgattttaagggatgctggtgcttccagatttcaagtgggaatagacttctttgaataagcactttggacaccctccactgggcaagagtgtcccatctttttctctggcccatttctctcccatctccctccctctttctcctcttcctccactgatctggctgtaaagaggagcgctaccgcctcacaggtcctgcgtccatcgcttttcaattttcactggatggcaggtgaatggaagctccagggtcttttgccccaaaatgacccctcccacatggaggggcttgggctgagcggacgtgcagatgggtcagtggccacacggcctacagaagaagcaggagggctgagagcccaaggcccatagagcctgcccaatgggcccagaaccacagtctcaagtcccagaagcttcagactgagatgctgaaatcaaagaatcacccactttcagaatcaaagggccagcacttcctgggatcccagacgccccaacttaagagtctcataagtggggaccagattctgggaatctcagaatctcaggactagcaagccccaaacccctattctggagaagcgaaggagctgggctcccatccgaagcagcatccttcctggtggccgagtctctagatgaagtggctccccatcaggaagccaacccccaagcgcgtgtgcacgcatcatgggaatgcctcataccccaatgcatgactgcgctggggtatccagctcctgcctgctcacctcctgtgaccgagaactcactcctccttgcagctcattccagctccatggctttgctgggaggaagtgctccctacatcttcgacctctccaaggaggccccacagagacctgggacagcccccaggcctctctcctctcggctgagcagcctgtgccaacccttcttaagggaggctcctctgggcatcttggagacccaacttggcgagagaccccagctgtcactccaactagggcaggacctccctgcctggcaccccagtcaccacagacctggggaacagagaccaagcatcatcccaggctcagagtctgccagaccaacagatgaatgagtgggtggccgcttctccagcccagctacgtgtctgggagccaggatctgcctgggtggccccttaggagttcggcccacatgctgacttcagagcatccggggactgctggggcctggcgatcggggggcccggctgctgtgtgccgtgtgcggcttgcggctgatgatcagctccaagacatcacccgcctcggccaggagtggcaccgccaggcagcagtcgaagtcccgtgtacggacgtggttgacctgcaggaccctgtcgaagggctggaggcctccacggtgggctggcccatcagggcgcacagtgtggacatagacacctttttccaggaggccatctgagacgctgaaaccaaagtcatgccgcatggggtccttgtgcagggtcaccttgtgcatctccaagggtgtaggcagcaacagctcctccatttctgcaggagaggctcgtacctcccggcccctctgccaaggccggtggccaggcctgccctcgagggccaccctctgcacggtgcccgtcatgatggatgcctccagttccctcagcagctctgactgaccacatgactccaggtcttcgagagcttctccaaacatgcgccagaagccctcctctcgggcagggccaggggctgggctcgttggcggctcccaatcatccccctcctcctcctctggaaagctctcgtcagctggggttggggtatagctcgtcctccggggctcggtgggtggggggctgcccctcagccagccaggcctccgctcctggggggtcgtgccccgggctgctgcctgtggtgtataggaccctgggcccccaaagccaccctcggtggccgagctgtcccaagactccacagcactgtccacactgggcacagccggcgagaagcgggctgctggcaggcctcctttcagggcatctgctgggtcctcatcagcatcactggtctcactgaggctgcccgacttgcggggtaggaggggacggtctagttgcttcttgatcttcagtgtgacggtctctccagccacctgcaggaggtggatggcctcgctcagcggccggcccttgaggctaacgttgttgatggccagaatgcggtcccccacgtggatggcaccagtcctctcagccaggccacgcttggtgaggcctgagatgacaatggggtcaaaaggttcctccgtgcccgaaatggtgatgcccaggggacccccgtagcgcttcagctccactgtgtagctgacggcacctgtggtctccagctcatcagagttgtcctcgtccttccggatcttcagcttcaccaggtcctcgcactgccgcaggatttgcacggcgtcctccatggggcagttgtccaggcggatattgtcaatggccagtagcttgtcgcctggctccagggtgcccgtcctgtgtgccacgctgcctttcttgatgtcggagatgatcaagggctcccctcgtttcctgctggccgagctgatggtgatgcccagctccacgctgcgcttcttgggcagcttcacgtggaaggtgccactgcttgggatgacggactccgccacatcgaactccacctccagcacgaccttgtgggccagcgcggcgtcccgcaggagctggttggcttcctccatagtcccgtcctcggtggcaatgccattgatggacaggacacggtcccccacctgcagcagcccacacctctcagccgggctgtcaggctcgatgaagcacacgaggggtggggaggacagggtctcggtggcgaagatgccgccctggagctggaggccaaagccgctgagggggtctccacagagcacgacctccgtggtctccgtgtgcacaatctgcccgcccggccccaccgtgctggaggctagcgacaacgagctcttgtgttcccttcttcgctgcctcctccgccccattgtagttcgaggactcatgggctgggatccacggggaagggtgctggggttgttgcaggaaaaggcgtggttcaaggtcggcgaggaaaagggagttgaagacaaggatcggctttggtcctggccagcaggtgtggcccaggtgggcatcctgcagtggccgggccgggggctgtggcaggagggcacgcaggggtcccagcggtgcagctgctcactcctctgcactttcactgcctctgagggcctcagtggccgctgactctggggcacaggcaggatctccagccgcaccttctctgaaatgctggccaggagcttggtggcctcaagcagcgagcagtgttccatgctggtgccatcgatggacaggatgtggtctccagggtgcagggctccgctcctgtccaccacgctggctggcttgatgcggtcgatggtaatgactgacttgttccggagggaggtggtggtgagcgagatccccagggcagaccctggcgtcttgactatttccaccatcaagggtcccgaagcattagccaccgtgtcaggggtggccacatcatactccacctgaaagagtgcctcgtggctgcactgccgcagggtggccagggcggtggcatggctggccccgtgcagcgggattccatcgacgctgagcagcctgtcgcccaccttcagggagccctccctgtcggcagggccaccgggccgcacgtaggtcaggacaagcgggcgggacttgtgcccatcttcatgggcacctcctctaaggacaaagccaaagctattgccctccttgtagagggagacgtc

SEQ ID NO: 499 - DNA, 860 bp, Homo sapiens
  modified_base (799)..(803): a, c, g, or t
  modified_base (805)..(807): a, c, g, or t
  modified_base (809)..(810): a, c, g, or t
  modified_base (812)..(812): a, c, g, or t
  modified_base (851)..(852): a, c, g, or t
ttttgttcaaaaactttatttgccttctgctcattataattacatataatcttcaaggagtttaaatgacaaccaaatccaaggcctggcccccaagaacacagtgataggattcagcatttggtgtttctaattatacaatgactacatatatatcatagacttgctctcatccattctccaccataaagtttcaatttcctcttaaaatatggcagtcaagtttagtctcattcaaaatcttatctggtcctacagcatattacagacttagactcactcttctgttttaattgatgttactgtgtagccgaagattttaaaaaaagatttatagatatacacttgaaattctgcagtcttgaaatactacaataaatttttcttacttatgaaaagccaacaacaacaaaaaaggccaggccaggcataagacagaggggaagggaagatgaggagggaggtttgagagtcccatcattttgccttgctgaaactgggtttcagtagaaatatttggcaagaatagtgtggaaaaggaggatggagaaagaggttactctgattttatgtaataattcagtttcaaaacatactgatatcaacctccaaaaatagtagttcacatctgcaatacaaataggcacacacggtaaagatggttaaaaagtagaatttaaaaggctatttgtccatcttcaggacattttgcaggcggccccaccctccccacatgtcctgtatttacattttactcttcagaaaagccccttttaaaagaatgctatttcttcctccnnnnntnnngnntntttttgttttgtattgttttgttttgttttgtttttaannagcaatta

SEQ ID NO: 500 - DNA, 1195 bp, Homo sapiens
  modified_base (149)..(153): a, c, g, or t
  modified_base (228)..(228): a, c, g, or t
  modified_base (623)..(623): a, c, g, or t
  modified_base (983)..(983): a, c, g, or t
  modified_base (999)..(999): a, c, g, or t
  modified_base (1004)..(1004): a, c, g, or t
  modified_base (1034)..(1034): a, c, g, or t
gctttagactattttccttcagttctctgcagtcgcagtgaaatacttcaagcgcaatttttgctgaactcttcttttcagcagtggaaaagctgcggaaatggaaacttacccccaacatatttcaatttggaagttcaacttcaaannnnnttcataaaaatgtaagttttattgagtgcctatagtgtgcatgggcctttattagacacgccaaattcaggcacnacagacacaagatccctggcctcaggtaccttatgatctaattaatagatattagaaacagtagaaagacaagttacacgtcaatgcccaatgactagagtcaacattaaagagttgtaatttaagtaatccaaactgacatctaattccaaaatcatttataaaatgtatttggctttggaatccacaggacttcaaacaagcaaagtttcactgcagatagtcacaaagatgcagatacactgaaatacttaagagccttattaatgatttttgttattttggatcttctgtttttttcttattatggtccgaagcctccttaataccaatttatcagacagaagcatgtcatcttgttgttcaagataatccagtaaattttcagtccattncaagtgccgctttatggctaatatgcttctctggattcagttctgtttttctactcttactggaaggcttttgctcagcagccttggtctggtcctcagcactttcactgtcagtcagcacctgacagcttgagtcactgctccgagagtcgaaccactgatcaatattctcaatgtcaacatgttcacattcttctgtgttctgtaaaactgttgctaaattagctgctaaaatggctccttcatcaatgttcatacctgaattctcttcattgccagggaaaagttttttccatgctttggttatggtacttgattttaccatgttccaagctcttgacacttcataaattgcatccnaacactgtcaagttcnttccnaaaatatttttgggtcatttccttcatccnatgtatttctggagaagtcctgctcgatagtatctttttacagtggctagaactccctggctcattggttgaatcagacttgtgacatttggtggcaaatacttcacaattattctgccatcatctgaactcaacatttcttcatttggacgtgctggggg

SEQ ID NO: 501 - DNA, 2123 bp, Homo sapiens
  modified_base (1778)..(1780): a, c, g, or t
  modified_base (1784)..(1784): a, c, g, or t
  modified_base (1786)..(1789): a, c, g, or t
  modified_base (1791)..(1792): a, c, g, or t
  modified_base (1794)..(1795): a, c, g, or t
  modified_base (1797)..(1800): a, c, g, or t
  modified_base (1802)..(1809): a, c, g, or t
  modified_base (1811)..(1812): a, c, g, or t
  modified_base (1814)..(1814): a, c, g, or t
  modified_base (1816)..(1819): a, c, g, or t
  modified_base (1821)..(1821): a, c, g, or t
ttatagttattcttttccttatgaaaaacaaaaaggggactgggcgtggtggctaacacctgtaatcccagcacttggggaggctgaggcgggcagatcacaaggtcaggagttcgagaccagactggccaaaaggatgaaaccccatcactctactaaaaatacaaaaaattagccaggtgcggtggggcgcaccagtaatcccaactactagggaggctgaggtaggagaatagcttgaacccgggaggcggaggttgcagtgagccaagatcgagccacggcactctagcccaggtgacagtgtgagactctgtctcagaaaaaaaaaagaaaaacgggatcgagatggtttgcaggattagcaagtgatagagatatattgaagacatagaaagccagtgtggttgctcacacctataatcccagcactgtgggaggccaaggcaggaggatcacttgagtcaatgagttagagaccaacctgggcagcaaagtgagaccccatctctacaaaaaaattttttaaaaatcagccaggtacggtggtgcacacctgtaatcccagctactaaggaggctgaggtaggagaatctcttgaacccgggaggcagaggttgcagtgagccaagatcgagccacggcactctagcccaggtgacagtgtgagactccatctcagaacaaaaagaataacaggatagggatggtttgcaggattatcaagtgatacagatgtactgaagacacagaaagccagtgtggttgctcacatctataatcccaacactttgggaggccagggcaggaggatcacttgagttgacgagttagagaccaacctgggcaacaaagtgagacccccacctctacaaaacattaaaaaaaaatgagctgcacatgttggcacgcacttgtaatcccagctacttgggaggctgaggtgagaggatcacttgagcacaggaggttacagtgagctatgatcacgccactcgacaccagcctgaatgacagagcgagaccctgtctcaaaaaagtggggggaaataaaaggatatagtgcactggattgaaactttctcctgtcgttatcataagcagaagaattgaagtaactaaaaagagaatcatagtctcaatgtgtgcttgaatgttatttaacatcacgtctctgctacctcatcattaaccagctgtggtaatgattccacactttgaacccatcccacctgttgacagaagcgattgcaatgccagcatcactcagtgacggctcatcatgtagggcccagaatactgattttgtgacttctaagcttgtgctccattcccaacacaaagtcttctgaccagcctttgagtaccattattgtagaggaagctcatcttaggtaactattactagagcagaaatcacttaatataaaatatttcatgtatcaaatttaaaactcacttttgggttcattgatgtagtaactcaaccaggaaacttaaatggaattagtgttttcactgacaataatgatgctgctttttcattataggcccataagatggcctggcctttccttgaaccagtagaccctaatgatgcaccagattattatggtgttattaaggaacctatggaccttgccaccatggaagaaagagtacaaagacgatattatgaaaagctgacggaatttgtggcagatatgaccaaaatttttgataactgtcgttactacaatccaagcgactccccattttaccagtgtgcagaagttcnnnaatnannnntnntnnannnntnnnnnnnntnnanannnngnaggtctcataacaacaaactgcagtctacagcttcttaaagttcagcgtgttaacctaacataaaacacagcaagaatctggttgtctgaactattttaaattaaggagccagatgtttttagtcaggctatcctgacaagacttgacctaaacttcgtttttattggccataacagtccaattatattcttggccaattttgtccaacggacaagaaaaaagcaaagtcaacgacaccattatcttgtcaagatcagatggttttactattgtggcagaagcgagaaaactttgtttgttg

SEQ ID NO: 502 - DNA, 2111 bp, Homo sapiens
  modified_base (333)..(333): a, c, g, or t
  modified_base (905)..(905): a, c, g, or t
  modified_base (935)..(935): a, c, g, or t
  modified_base (955)..(955): a, c, g, or t
  modified_base (1509)..(1509): a, c, g, or t
  modified_base (1581)..(1581): a, c, g, or t
gagggctcgaggtgccacggcgtccaggagcgaggacagggccagctacaaaagaccccacagctgtagagagagcaaacttgttaaacatggctaaactgagtatcaaaggactcattgaatctgctctgagctttggccgcactttggattctgactatccccccttgcagcaattctttgttgttatggaacattgcctgaaacacggtcttaaagtaagaaaatcatttttgagttacaacaaaaccatctggggccctttggaactggtggagaagctgtaccccgaagcagaggaaataggagctagtgtccgggatctacctggtnctgaagacccctctgggtcgagcaagagcgtggcttcgattagccctcatgcaaaaaaaaatggccgattacttacgttgcttaattattcagagggatctcttgagtgagttttatgagtatcacgcactaatgatggaagaagaaggagcagtaattgttgggctgctggttggcctgaatgtgatcgatgctaatctgtgtgtgaagggagaggatttagactcacaagttggagtgattgatttttctatgtatttaaagaatgaagaagatattggaaataaagaaaggaatgttcaaattgctgccatattagaccaaaagaattatgttgaagaattaaatagacaactgaacagcacagtcagcagcctccattcaagagttgattcattagaaaagtcaaatactaagctgattgaagagttagcaatagcaaagaataacatcattaaactccaggaagaaaatcatcaattacgaagtgaaaataaattgattttaatgaaaacacagcagcacctagaggttaccaaagtagatgtggaaactgagcttcaaacatatangcattctcgtcaggggctagatgaaatgtncaatgaagccagaaggcagnttcgagatgaatctcagttacgacaggatgtagagaatgagctagcagtacaagttagtatgaagcatgagattgaacttgccatgaagttgctggagaaagatatccatgagaaacaagatactctgataggccttcgacaacaactagaggaagttaaagcaattaacatagagatgtatcaaaagttgcagggttctgaagatggcttgaaagaaaaaaatgaaataattgcccgactagaagaaaaaaccaataaaattactgcagccatgaggcagctggaacaaagattgcagcaagcagagaaggcgcaaatggaagctgaagatgaggatgagaaatatctacaagaatgtctcagtaaatctgatagtctgcagaaacaaatctcccaaaaggagaaacagctggtgcaactggaaactgacttgaagattgagaaggaatggaggcagactttgcaggaagatcttcaaaaggagaaagatgccttatctcatcttagaaatgagactcaacaaatcattagtcttaaaaaagagttccttaanctccaggatgaaaatcagcagttgaaaaaaatatatcatgaacaagagcaagctcttcaagaactcggcaanaagcttagcgaatcaaaacttaaaattgaagacataaaagaagccaacaaagcattgcagggactggtttggctgaaagacaaagaagcaacacattgtaaactttgtgaaaaggaattctcactctctaagagaaagcaccactgtagaaattgtggggaaattttctgtaatgcctgctctgacaacgaactacctttgccttcttcaccaaaaccagtacgggtttgtgattcctgtcatgcattgctcattcagagatgctcatctaacttgccctgagactccagaactaaatccttatgtatgaaattacctacaatgaatgttatgatgttgtatacaaagacatggcagctactgcatcttcatgtgtcacaaactctacatctgcttctcctgtggctctgccatcagctccaatatcaatatgaactcgtattggatttagtggtgagaagaactaaataaaaggaaacacttatttacttttctattgagaatattaaagtaaattaccacataccttg

SEQ ID NO: 503 - DNA, 1105 bp, Homo sapiens
  modified_base (8)..(10): a, c, g, or t
  modified_base (12)..(12): a, c, g, or t
  modified_base (36)..(36): a, c, g, or t
  modified_base (325)..(325): a, c, g, or t
  modified_base (811)..(815): a, c, g, or t
  modified_base (820)..(821): a, c, g, or t
  modified_base (823)..(823): a, c, g, or t
  modified_base (897)..(897): a, c, g, or t
  modified_base (958)..(958): a, c, g, or t
  modified_base (960)..(961): a, c, g, or t
tctctccnnntnacagtgaaacacttttatgaaggntgcctgagaggtaatctactgacttggagagtatgttcaagggatcatataggaaagtcatgggctcttccccacgcaaccatctccagagacctaaataaaaagcaaatttaatacgaataagtggacagatgagctgcccagtaggcaggcactgagagactgatcagtgggatactcaagcagagtgagacagagcggaaccttccaagtggtattagtgttgacctggattacatcccataatgagttctggatccagaattacctgagggaaggggtctgttancagtgccataaagggtcagtggctctgatctcccaggcgtcagggtcccttgcagagatgactgagaaccaagtgcacaaagcacagatgaagctgctacaggctggaaccccaggggccactggaatgtccatttcctgcagcctgcctatactgaggtttaatctagataacgtttgacaaaagggtcagggtaagattaggagatgataattaacctctaggagtctacctcattgtacagctgctcccccactgggtactcccattcttctaagaccaagggctgccagtgggacccacactgctctgcatcaagcttccagaccactgcccaccctcccttcctcaaaaggctctcacctgggagatgctatcctgtcatgcctgctttcccctctggcaggtgccactggccttgtggccactcctcttgttcaccaaggatgctgactcctaggtcacaccattctcctcaacatctgnnnnnttctnncntcagcacccatgtggaggctcaccctgccctccagcctcgccaaccctagatttcacttcttaaggctcctccntggctctggccagcaaccccaggtcataccctctattttgcctttacctgagattgctccncnnctcaatttccaaagcactcctgtctggctcaaatatacctccctgcccaacccctcaccatgctggagtttctatcttgtcaagacctctaatttcctaatccctccctagtcacctcctgttttcaattccaatttcttggtc

SEQ ID NO: 504 - DNA, 665 bp, Homo sapiens
  modified_base (470)..(470): a, c, g, or t
  modified_base (536)..(538): a, c, g, or t
  modified_base (540)..(545): a, c, g, or t
  modified_base (547)..(553): a, c, g, or t
  modified_base (558)..(560): a, c, g, or t
  modified_base (562)..(564): a, c, g, or t
  modified_base (566)..(572): a, c, g, or t
tgaattattggcaaatatataacatattttgtttctccagtcttcatttctcctttttttctgctgtacatctcccaaaggtcataaatcatacaccaacaaacaaaaagtttcttacatatatacacctgtcaccacagttcagctttccattcctattcctgatctatattcttctcctatgtttcagataactgactccacacaacaaattatgtgtccattgttttcttgatttctttttaacaaatgctaaactataaagtcatctgcacttttgtaagtattttaacaaggccaatacattccaggtatttaagaagccacaggagaaatctagggtcctttggcttgttgctttacattgaatttacctacatgtggaaaaccactaatctggatccctacttcaaactaatttttgcctcctagaaaggcagtacgtaattcttaaaatataaagatcaaanttaaatcaaatcatacttgacttgcattccagctgtgctctttgacttgtcaaagtctcaatttcnnnannnnnnannnnnnnatggnnnannntnnnnnnnatgcctggaaatggatgcgagaaagactgagtccccatggatggctcatgccaaatcaaacagtactaaaaacctcagacacctgatgtggcc

SEQ ID NO: 505 - DNA, 682 bp, Homo sapiens
  modified_base (37)..(38): a, c, g, or t
  modified_base (40)..(40): a, c, g, or t
  modified_base (477)..(477): a, c, g, or t
tttttttttttttttgagatggagtctcgctctgtcnncnaggctggagtgcagtgatgtgatctcggctcactgtaacctccgcctcccgggttcaagcgattctcctgcctcagcctcccaagtagctgagattacaggcgagtgccaccacgcccagccaatttttgtattttagtagagatggggttttaccatgttggtcaggctggtctcaaactcctgacctcgtgatctgcccacctcggcctcccaaagtgctgggattacaggtgtgagccactgcgcccggatgaaatacaagagatttttaaagaagttttcaaactattcaggttacagacacaaatttatagaattaaggagatttatagtgtacatcaaagttcatagcttatttatttgcaattttgtggttcgtaaactaatgaagaattatactaaatgacctatatagtctcttttagctataaactntcaattatattattctgctttaaaataattaagaccatatctcaaagttgtttaagtagataatgtcggccctgaattaaggatttttttttcatcccctttctggcttttagtccttcctagtcagttattaatggggaataaatattacacattttactcaactgattcttaattcctagctctattgccccctcctctcctc

SEQ ID NO: 506 - DNA, 714 bp, Homo sapiens
  modified_base (533)..(537): a, c, g, or t
  modified_base (541)..(549): a, c, g, or t
  modified_base (551)..(554): a, c, g, or t
  modified_base (652)..(653): a, c, g, or t
  modified_base (655)..(656): a, c, g, or t
  modified_base (658)..(660): a, c, g, or t
  modified_base (662)..(667): a, c, g, or t
  modified_base (669)..(677): a, c, g, or t
  modified_base (679)..(681): a, c, g, or t
acttcccaaaaccccaccttctttttttttgggcaggttttggggtggcctcccactttggcgtcctaacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggctgacatctgctcccgagagcacatccgcaagtcgctgggactccccgggccacccacaccgaggagcccgaaggcgcagaggccagtggcatgccccaaaggagactccggagagtcctcaggtggagcacccagtccccaaagacaggctgaccgcaccaccccagggggacgccgcagcacagcccagcaccaggtggggcagaggtgaccacggcccctctttgctccgtcatcggctggtcagctgtggtcacggtgcctcagaggacagatctctatgggggcaagtgccagatcctgagagcgcatnnnnngctnnnnnnnnncnnnngaaggggactcggagctgcagcctgcacgacccctgcagcctgtgctttgcccacccctttcaatagatggaacttgcttgctcttttttaaaaaaannannannnannnnnnannnnnnnnnannnaaaaaaaaaaaaaaaaaaaaaagtcgtatcgat

SEQ ID NO: 507 - DNA, 462 bp, Homo sapiens
ttttttaaaaagatgtataagactgtacagaaaacattgtaaaatttagagaagctaaagaagtgcagtcctatgctacacagatggaagggaagaatatcctacacaggtaattgggtatggcaagcaaggctagaactgaggaaaaacagaatcaggcccagcctaaaagcagcacactactgacatatggaaatgtagatttccattccacaaatcttactatgtttctaagagaaactagaagtccagatttctatggaaattcttttttcttttttatgtactggcagaaacaattttaaataccacacaggacaaaaaagaacacatctgtggaagaatttggccccgagccaccagttttctactcctgcaatctacctacttatctttagataattcattaatatttctgggttgtgcttaacctacacacgcaaaaggttacacacactacag

SEQ ID NO: 508 - DNA, 789 bp, Homo sapiens
  modified_base (53)..(53): a, c, g, or t
  modified_base (533)..(533): a, c, g, or t
  modified_base (627)..(627): a, c, g, or t
  modified_base (629)..(631): a, c, g, or t
  modified_base (669)..(669): a, c, g, or t
  modified_base (672)..(672): a, c, g, or t
ctttttttgttacaaaataaaacaaaagcatttatgtaattcagaaaaaaaancatgaattttcactccaaagacatagcacagaaaagcttacttacaattaccaacaccacactattgtacctttaaatatgcaaaggtaaagagactcaaagttgcattttaccatttttaatctctccaaattagacaagcaatctaaaagaagatgtcacacattcctgtttaatgcatttgctgaaatctttcagactttaaaaactttaggtaaaagcaatggcaacttgaagtttcttttccaatcatatttaagttagccattaaatgctgaattaacaattaatccatacaataatataaaaatacacatattaaatcacattgtttttcattattgaagcttaataaaaatatcattttaatataaccattttgaagaactcaaatggctgaacttattatagtgtctaaattataccatcaatagaaacattacattttccccccagttggtgaaaatgagctcatgcaangtatttctgacactcacagtgacacatatggtctgccattctaaagatgtacaagcagctctcacttttaaacatgacaatatgattcagaatnannnagcatttgttaaaaataccagctttcacatgtttcatnaanctctaaaccaaaataataattttgatgtgtttcaggtatcagacaaagcagataatttaaaaggtaaatgattctactagtgcagactagttatcactgtggctaattttaaaacga

SEQ ID NO: 509 - DNA, 451 bp, Homo sapiens
  modified_base (4)..(6): a, c, g, or t
  modified_base (9)..(9): a, c, g, or t
  modified_base (54)..(54): a, c, g, or t
  modified_base (255)..(255): a, c, g, or t
  modified_base (261)..(261): a, c, g, or t
  modified_base (280)..(280): a, c, g, or t
  modified_base (284)..(284): a, c, g, or t
  modified_base (296)..(296): a, c, g, or t
  modified_base (316)..(316): a, c, g, or t
  modified_base (329)..(331): a, c, g, or t
cttnnntanatgcacagtgcaggcagaaagtagaatgcatcttcaattgtcctntaggctgcctgtaaccttttcatgggcaacttgttctaatgccaccagccaacccatgttttagtttgctggggctacattacaaagtaccacagactggagggcttaaacaacataaacttattgtctcacagatctggaggctaaaagtgtgagattgagaggctggctggcttggttccttctgagggctgtgagggnaggatncattccagacttctctccntggnttgctgatggcntgtcttctctctctgtcttnacatcatcttccnnntgggtgtcactgtgttcaaatttcccttttatagggacaggttagtaagattagggcccacccttatgacctcgttttaacttctataatgatctagtttccaaataagttacaccctga

SEQ ID NO: 510 - DNA, 422 bp, Homo sapiens
  modified_base (13)..(14): a, c, g, or t
  modified_base (25)..(25): a, c, g, or t
  modified_base (88)..(88): a, c, g, or t
  modified_base (110)..(110): a, c, g, or t
ttttttttttttnnttctggcatangtaggggcagtatatggggttctaacctctattttattttattttatcttatattatcttatnttatttttttaccacttcccanatacccacttctttaaatgactttagttggtgctcttcttttcagtctcaccttatctctctctctctctctcctctttcttttttttttttttttcggagttttgctcttgttgcccaggctgctggagtgcaatggcacgatctcagctcaccgcagcctctgcctcctggctcaagcgattctcctgcctcagcctcccaagtagctgggcgttacaggtgtgcgccaccatgcccagctaattttgtatttttagtatagacggggtttctccatgttggacaggctggacttgaactcttggcctcc

SEQ ID NO: 511 - DNA, 501 bp, Homo sapiens
  modified_base (234)..(235): a, c, g, or t
  modified_base (237)..(238): a, c, g, or t
  modified_base (240)..(248): a, c, g, or t
  modified_base (250)..(253): a, c, g, or t
  modified_base (256)..(261): a, c, g, or t
  modified_base (264)..(265): a, c, g, or t
  modified_base (271)..(272): a, c, g, or t
  modified_base (274)..(275): a, c, g, or t
  modified_base (278)..(278): a, c, g, or t
  modified_base (282)..(282): a, c, g, or t
  modified_base (290)..(290): a, c, g, or t
  modified_base (340)..(340): a, c, g, or t
  modified_base (372)..(372): a, c, g, or t
  modified_base (387)..(387): a, c, g, or t
ttttttttttttttttttttttgactcaaaagcttgctttatttgaggacaatttcatcctgaaaaccaggagcggggtgttgcggggtgggagggcggccaagacgtctgagcagtatcccaggcaccccttccagcccagggtgacctcgaaagcagcagagagaacggggactggaggcgggtgggccctggaaatcctctcatggtgcgggtggggggggtatggggggnngnncnnnnnnnnntnnnngcnnnnnngcnnctcctnncnncangaanaggcccangtgcagcaggaaaccccgtccctggtgctcactggtgaccgtgggcagangagaggacaagtctctccacacagcagcctgnggccatggggtacantccatcttttgccaattgtcttcttttatttattctggcaaaatgcccattcccaaaggcttctgcatcctgtccatcagacaggacagtcgtgccttttcaaagtccaaggct

SEQ ID NO: 512 - DNA, 2617 bp, Homo sapiens
  modified_base (208)..(244): a, c, g, or t
  modified_base (526)..(678): a, c, g, or t
  modified_base (704)..(704): a, c, g, or t
  modified_base (741)..(741): a, c, g, or t
  modified_base (775)..(775): a, c, g, or t
  modified_base (791)..(791): a, c, g, or t
  modified_base (858)..(858): a, c, g, or t
  modified_base (864)..(864): a, c, g, or t
  modified_base (888)..(888): a, c, g, or t
  modified_base (895)..(895): a, c, g, or t
  modified_base (1087)..(1087): a, c, g, or t
  modified_base (1098)..(1125): a, c, g, or t
  modified_base (1227)..(1227): a, c, g, or t
  modified_base (1341)..(1341): a, c, g, or t
  modified_base (1382)..(1419): a, c, g, or t
  modified_base (1637)..(1637): a, c, g, or t
  modified_base (1680)..(1680): a, c, g, or t
  modified_base (1729)..(1754): a, c, g, or t
  modified_base (1837)..(1857): a, c, g, or t
  modified_base (1958)..(1959): a, c, g, or t
  modified_base (1963)..(1963): a, c, g, or t
  modified_base (1998)..(1998): a, c, g, or t
  modified_base (2031)..(2031): a, c, g, or t
  modified_base (2041)..(2041): a, c, g, or t
  modified_base (2069)..(2069): a, c, g, or t
  modified_base (2089)..(2089): a, c, g, or t
  modified_base (2095)..(2095): a, c, g, or t
  modified_base (2543)..(2543): a, c, g, or t
  modified_base (2570)..(2570): a, c, g, or t
  modified_base (2596)..(2601): a, c, g, or t
gcgggccgaggagccgggcgcaatggagcggaagaggtgggagtgcccggcgctcccgcagggctgggagagggaagaagtgcccagaaggtcggggctgtcggccggccacagggatgtcttttactatagcccgagcgggaagaagttccgcagcaagccgcagctggcgcgctacctgggcggctccatggacctgagcaccttnnnnnnnnnnnnnnnnnnnnnnnnnnnnnnnnnnnnnaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgaccgacgaggacatcaggaagnaggaagagctggtgcagcaggtgcggaagcggctggnggaggcgctgatggccgacatgctggcgcacgtngaggagctggcccgtnacggggaggcgccgctggacaaggcctgcgctgaggacgacgacgaggaagacgaggaggaggaggnggaggngcccgacccggacccggagatggngcacgtntagggcaggtgctgcggggccacgggggctccctggagtcgggtcctggcagtggggactgcctggtgaacacagatgtgcttgggatgacgggtgcctcccaagagcttcccatctccctagaagagcccaagcgtccccgtcccgtggagtcgctaaagccagccctccctgtcctttccagaggccctnccgagagcccnnnnnnnnnnnnnnnnnnnnnnnnnnnngcggtcctcggccccacgtgaaccaggctcggcggcgaagcccagccttggagacacccaggaggaaggccgtgctcctggctccctcctcggcccgtcccnacttcccggggcctcggggcacacagctggggctgcccccacccgaaagaccctccacgctcgtcctctacagagtccggcttcgggaagtgccgggtgctcctgggccctgcntggctccctacgacctttgggctcgaggccagctcctcccnnnnnnnnnnnnnnnnnnnnnnnnnnnnnnnnnnnnnnccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcgtgcccaggnaggccgctctccttcagtaaatgtaacacagtcgaggcacgtnatcgggcagccttccctgtgtgccaacgccagccttcgcttctgaaaannnnnnnnnnnnnnnnnnnnnnnnnnacttggtcgcccggcgctgccagaatgctccactgccagccggcccccctgcctcggtttcccttctgtttagtggcgacacnnnnnnnnnnnnnnnnnnnnntgctgacgctcccaggggtgccaggagccactgggacagggtgaggctcccagacgctcctcgaggtgcccagctctccagggagcttctggcccaaggcnntctngagggatctgctccttaaccccccagtgccttggngagggcaggttccaagccacagacgcctgcccngagtggactntgcggccagtccctggtgccctcctggnccctgctgcccagtgagggntcctancgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccnccatgggtggatgtgcttggaaaaaanaaaaaaaaaaaaaaaaaaaaaaaaannnnnnaaaaaaaaaaaaaaaa

SEQ ID NO: 513 - DNA, 1248 bp, Homo sapiens
  modified_base (20)..(20): a, c, g, or t
  modified_base (22)..(22): a, c, g, or t
  modified_base (24)..(27): a, c, g, or t
  modified_base (29)..(32): a, c, g, or t
  modified_base (83)..(83): a, c, g, or t
  modified_base (85)..(87): a, c, g, or t
  modified_base (516)..(516): a, c, g, or t
  modified_base (710)..(724): a, c, g, or t
  modified_base (743)..(744): a, c, g, or t
  modified_base (778)..(793): a, c, g, or t
  modified_base (875)..(875): a, c, g, or t
  modified_base (931)..(941): a, c, g, or t
  modified_base (944)..(944): a, c, g, or t
  modified_base (946)..(946): a, c, g, or t
  modified_base (948)..(952): a, c, g, or t
  modified_base (954)..(954): a, c, g, or t
  modified_base (956)..(959): a, c, g, or t
  modified_base (961)..(972): a, c, g, or t
  modified_base (975)..(977): a, c, g, or t
  modified_base (981)..(981): a, c, g, or t
  modified_base (996)..(996): a, c, g, or t
  modified_base (1018)..(1018): a, c, g, or t
  modified_base (1025)..(1025): a, c, g, or t
  modified_base (1067)..(1067): a, c, g, or t
  modified_base (1081)..(1081): a, c, g, or t
  modified_base (1093)..(1093): a, c, g, or t
  modified_base (1095)..(1095): a, c, g, or t
  modified_base (1109)..(1109): a, c, g, or t
  modified_base (1112)..(1113): a, c, g, or t
  modified_base (1115)..(1115): a, c, g, or t
  modified_base (1121)..(1138): a, c, g, or t
  modified_base (1141)..(1141): a, c, g, or t
  modified_base (1143)..(1143): a, c, g, or t
  modified_base (1149)..(1149): a, c, g, or t
  modified_base (1166)..(1166): a, c, g, or t
  modified_base (1168)..(1170): a, c, g, or t
  modified_base (1175)..(1176): a, c, g, or t
  modified_base (1178)..(1179): a, c, g, or t
  modified_base (1188)..(1189): a, c, g, or t
  modified_base (1194)..(1194): a, c, g, or t
  modified_base (1203)..(1203): a, c, g, or t
  modified_base (1207)..(1207): a, c, g, or t
  modified_base (1216)..(1216): a, c, g, or t
  modified_base (1220)..(1220): a, c, g, or t
tttttttttttttttttttntntnnnntnnnntactttttgaaagtttcatttaggtgctatcatttaaaaaatcagaagatntnnnttaagaatccagcattctagtttctttcgaaaaatcagaagatctggcaacactaggcccacattccggcatggcaacaaccagctagagcggtgctggctgttccccctctgtggggcttgtgctctggtttctgaagtcctaaccctcaccaggcccaactgccacctacgccagctgcatggcccctacactgtgtctctgcacgaggcagcccagcaggaaggaacaaaagtgggggtgatgagaggttgtcctgttcagccctccccactacccacaggcctgggcacgtgaaggaggtcagagtagggtgagcaggaaggcagggggggtcccggacaggacacaccccagcctctctctgatcactgtgcatggcaagcagcgtcccaggcaccccacgtgtcctggcccagcccaagcctnccttggcggccgggtggctgcaattgcgtagcttgctgtcttggtcctggccactccacatcctgtcagagctgggcccacgacctgaggccttgtcctgagcctgagcaatatggcctgtaggtacaggcttcctcactgtccatccagctcagctgaatgtgcaccagggtgtggcggtcttgtcacagtcnnnnnnnnnnnnnnngacagtgcagggggccccnnccacagacagggcagtgcgggaagccacatggtnnnnnnnnnnnnnnnngcctccctccctgtccaccttgaactgctcctgtttttgagctgcgatgcgcttctggtccctcttccgccaggctgggtcntgcaggtggcgaaatgtcttgtacccagttgtgattcccgaggggcggaaaagctnnnnnnnnnnnccntnannnnncngnnnnannnnnnnnnnnncgnnncccnagccccagaagcggntggacatcccattgcacagccngtagtgntgcttggagagcagcaggatgccgccgacataggtcttgtantggtagagagggtnggagctccgggnangccacgtggaaggnccnnancctcannnnnnnnnnnnnnnnnntcntngttganagggagcaggtcaacgncnnncatgnnanngtagtccgnnctgtngctgctctncagnaagcccacnttgntgaaccctgcccggtggaactgaagtgg

SEQ ID NO: 514 - DNA, 30 bp, Artificial Sequence
  Description of Artificial Sequence: Synthetic oligonucleotide
aagcagtggtatcaacgcagagtacgcggg

SEQ ID NO: 515 - DNA, 24 bp, Artificial Sequence
  Description of Artificial Sequence: Synthetic primer
aagcagtggtatcaacgcagagta

SEQ ID NO: 516 - DNA, 27 bp, Artificial Sequence
  Description of Artificial Sequence: Synthetic primer
cggtaatacgactcactatagggagaa

SEQ ID NO: 517 - DNA, 10 bp, Artificial Sequence
  Description of Artificial Sequence: Synthetic oligonucleotide
aaaaaaaaaa

SEQ ID NO: 518 - DNA, 20 bp, Artificial Sequence
  Description of Artificial Sequence: Synthetic oligonucleotide
gagtgagaggcaacctggag

SEQ ID NO: 519 - DNA, 20 bp, Artificial Sequence
  Description of Artificial Sequence: Synthetic oligonucleotide
gtgaagtgagggctcccata

SEQ ID NO: 520 - DNA, 20 bp, Artificial Sequence
  Description of Artificial Sequence: Synthetic oligonucleotide
ctcaaatctcctccgagacg

SEQ ID NO: 521 - DNA, 20 bp, Artificial Sequence
  Description of Artificial Sequence: Synthetic oligonucleotide
tgaagtggcttggtgtcttg

SEQ ID NO: 522 - DNA, 20 bp, Artificial Sequence
  Description of Artificial Sequence: Synthetic oligonucleotide
agaggtgttccaggtccaga

SEQ ID NO: 523 - DNA, 20 bp, Artificial Sequence
  Description of Artificial Sequence: Synthetic oligonucleotide
gctctggccacaacctaatc

SEQ ID NO: 524 - DNA, 20 bp, Artificial Sequence
  Description of Artificial Sequence: Synthetic oligonucleotide
tgggacattcaattcgacaa

SEQ ID NO: 525 - DNA, 20 bp, Artificial Sequence
  Description of Artificial Sequence: Synthetic oligonucleotide
gagaactggccaacttggag

SEQ ID NO: 526 - DNA, 20 bp, Artificial Sequence
  Description of Artificial Sequence: Synthetic oligonucleotide
ctgcctatcctgtgggagaa

SEQ ID NO: 527 - DNA, 20 bp, Artificial Sequence
  Description of Artificial Sequence: Synthetic oligonucleotide
actggagagccataccgatg

SEQ ID NO: 528 - DNA, 20 bp, Artificial Sequence
  Description of Artificial Sequence: Synthetic oligonucleotide
ggcttctgcagaggacagac

SEQ ID NO: 529 - DNA, 20 bp, Artificial Sequence
  Description of Artificial Sequence: Synthetic oligonucleotide
tcgtcgctgtcttgtagtgc

SEQ ID NO: 530 - DNA, 20 bp, Artificial Sequence
  Description of Artificial Sequence: Synthetic oligonucleotide
agtcgggagaggctaggaag

SEQ ID NO: 531 - DNA, 20 bp, Artificial Sequence
  Description of Artificial Sequence: Synthetic oligonucleotide
gtaccaccttggacccactg

SEQ ID NO: 532 - DNA, 20 bp, Artificial Sequence
  Description of Artificial Sequence: Synthetic oligonucleotide
gctaccgcatcctgagagac

SEQ ID NO: 533 - DNA, 20 bp, Artificial Sequence
  Description of Artificial Sequence: Synthetic oligonucleotide
tcaccttcctcgttgacctc

SEQ ID NO: 534 - DNA, 20 bp, Artificial Sequence
  Description of Artificial Sequence: Synthetic oligonucleotide
ctggtgtctgctaccgtgag

SEQ ID NO: 535 - DNA, 20 bp, Artificial Sequence
  Description of Artificial Sequence: Synthetic oligonucleotide
gggagccagtcagcaaagta

SEQ ID NO: 536 - DNA, 20 bp, Artificial Sequence
  Description of Artificial Sequence: Synthetic oligonucleotide
ggcatcctcaccctgaagta

SEQ ID NO: 537 - DNA, 20 bp, Artificial Sequence
  Description of Artificial Sequence: Synthetic oligonucleotide
ccatctcttgctcgaagtcc

SEQ ID NO: 538 - DNA, 2385 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgcacgacc

SEQ ID NO: 539 - DNA, 2470 bp, Homo sapiens
gcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtgagggccggacctccacgagcggaatgcggggtccgaactcggggacggagaagggcagactagtcatcccggagaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgcacgacc

SEQ ID NO: 540 - DNA, 2227 bp, Homo sapiens
taattcagaattgagtaaagaaatattttttctagtccttcatatattgaaaacttgccacatgacattgtatcgtcttcattttccagaagatgcgttggtgtgccataggtttctaacttccttgaaaatagttttttaagtcaattgtaaatatacgtattattgttaaaagtaactttaaactgcaacacatagcttcaaaacaatatagagattttgtaataccttataagtggagttggctaaaataccttatccatataaaacttattctattctttgcatgcttattttgtgtgttggttgctagcttaaagtttgatttgttgttactctttgtgtgccaaattcactaggcaagcggatttttcctcagacttcaaaaaataattcttttaagaaaaaatgtaaaaatgtttattctaaaaagctgcattaaagggacaacctataaaaagttttgctagctcatctttagaaggaagaaagaatattagcttgggtgatgtttaatttgggtggcgatagtttctgtaggctaaactttatgagaaaagtgtacctactctataaaggtaataaatgtaaaacctcttgctgttattgaggaagctcttcaactaccctaaatttcacaaatgtaacttataacactatgaaaagatttgaccaacaatttacgtttgctgtgtgctttagtttttgtttaagcatattcttttgcttgaatttctgtgttcatgagagttagggtgttttatgcttcttgaactaattttataacatatttaatatattaccagttaagatataaaatcatttgtacatagcgaattgtaaagcagctattaaagtaggtgaaataaagtatatatttgccggttatccatatcttttagaagtcctgacagaacaaccagtttatttgcacataggtagcttctgtttgaaggaaggtaaagttataaggaaactcaaatactataagatgtgtcaaggtatttctccagaattaattgcaaagctagtgctgaaggattttaatcagcttctaaaattttcttctcaataagacatatgttttgattacttagggaagattcctcatttttatttgccctttatgcatttaatccacatgataggacattaaaaattaatataaagaaaaatcgtgctcatactgtacatctatttctgtgcttggaactacttgttaatagtttttatcgaagctgtcagcaataagggacataaaactgctgtattatacattgtggaattgaataaacagcctaatttttttttttctagtatagggtacttaagcatttccacttttggaagaaaagtgtattagtattttatattgcatttcatttaaaaggacagttttttttttttttgtaaatccattcattgaaatggtttctaaactgtataatgtaatttggagcctatttagtaatagaattaaatgtcctatgtagtgctacaatttttgaattagaaagtgatcaaatgtaagaaaaaaatttaaaaattcagcccagaaaacaaaatagtgtattaaattagtttaatgtaaaaggaatttataagatttttttcctcaatatagatacctcacttgaaaagaaagcacagcatacttaaagtagttctagtaaacatgtcctagaaaacagttgctaaatgtaggacatcttttgaggaattagtttatgagaaataaaattttacttgtttttactatcctgttagaagtatttgtttatcctgataattttaagccaacatagtagtcttaaattacttttgaatttctaatctgtgaaggcagtaaatgaaatatctgttctgcaactgttgaaacaaataattggctacattgaccataattaaagttaaaattttgccaatgatgtacagttttatggttaaagttgctgtggttggttgcattacatgacacagaaaactgtcctctacctcacgtgaaataaatattttatatggttttactaaaaataagactcatgtatctggtcacctagtttacaaattttgaattatatttattgaaacatgacatactgtgctctgagcttatacctcaattgtattttgtgctgttttccattttcatgccttgtaaataacttgtatagattgtggatcaaatactaaataaaaacttttaatgccaaaaaaaaaaaaaaaa

SEQ ID NO: 541 - DNA, 2718 bp, Homo sapiens
cagggtaacgctgtcttgtggacccgcacttcccacccgagacctctcactgagcccgagccgcgcgcgacatgagccacgggaagggaaccgacatgctcccggagatcgccgccgccgtgggcttcctctccagcctcctgaggacccggggctgcgtgagcgagcagaggcttaaggtcttcagcggggcgctccaggaggcactcacagagcactacaaacaccactggtttcccgaaaagccgtccaagggctccggctaccgctgcattcgcatcaaccacaagatggaccccatcatcagcagggtggccagccagatcggactcagccagccccagctgcaccagctgctgcccagcgagctgaccctgtgggtggacccctatgaggtgtcctaccgcattggggaggacggctccatctgcgtcttgtacgaggaggccccactggccgcctcctgtgggctcctcacctgcaagaaccaagtgctgctgggccggagcagcccctccaagaactacgtgatggcagtctccagctaggcccttccgcccccgccctgggcgccgccgtgctcatgctgccgtgacaacaggccaccacatacctcaacctggggaactgtatttttaaatgaagagctatttatatatattatttttttttaagaaaggaggaaaagaaaccaaaagttttttttaagaaaaaaaatccttcaagggagctgcttggaagtggcctccccaggtgcctttggagagaactgttgcgtgcttgagtctgtgagccagtgtctgcctataggagggggagctgttagggggtagacctagccaaggagaagtgggagacgtttggctagcaccccaggaagatgtgagagggagcaagcaaggttagcaactgtgaacagagaggtcgggatttgccctgggggaggaagagaggccaagttcagagctctctgtctcccccagccagacacctgcatccctggctcctctattactcaggggcattcatgcctggacttaaacaatactatgttatcttttcttttatttttctaatgaggtcctgggcagagagtgaaaaggcctctcctgattcctactgtcctaagctgcttttcttgaaatcatgacttgtttctaattctaccctcaggggcctgtagatgttgctttccagccaggaatctaaagctttgggttttctgaggggggggaggagggaactggaggttattggggttaggatggaagggaactctgcacaaaacctttgctttgctagtgctgctttgtgtgtatgtgtggcaaataatttgggggtgatttgcaatgaaattttgggacccaaagagtatccactggggatgttttttggccaaaactcttccttttggaaccacatgaaagtcttgatgctgctgccatgatccctttgagaggtggctcaaaagctacagggaactccaggtcctttattactgccttcttttcaaaagcacaactctcctctaaccctcccctcccccttcccttctggtcgggtcatagagctaccgtattttctaggacaagagttctcagtcactgtgcaatatgccccctgggtcccaggagggtctggaggaaaactggctatcagaacctcctgatgccctggtgggcttagggaaccatctctcctgctctccttgggatgatggctggctagtcagccttgcatgtattccttggctgaatgggagagtgccccatgttctgcaagactacttggtattcttgtagggccgacactaaataaaagccaaaccttgggcactgttttttctccctggtgctcagagcacctgtgggaaaggttgctgtctgtctcagtacaatccaaatttgtcgtagacttgtgcaatatatactgttgtgggttggagaaaagtggaaagctacactgggaagaaactcccttccttcaatttctcagtgacattgatgaggggtcctcaaaagacctcgagtttcccaaaccgaatcaccttaagaaggacagggctagggcatttggccaggatggccaccctcctgctgttgccccttagtgaggaatcttcaccccacttcctctacccccaggttctcctccccacagccagtcccctttcctggatttctaaactgctcaattttgactcaaaggtgctatttaccaaacactctccctacccattcctgccagctctgcctccttttcaactctccacattttgtattgccttcccagacctgcttccagtctttattgctttaaagttcactttgggcccacagacccaagagctaattttctggtttgtgggttgaaacaaagctgtgaatcactgcaggctgtgttcttgcatcttgtctgcaaacaggtccctgcctttttagaagcagcctcatggtctcatgcttaatcttgtctctcttctcttctttatgatgttcactttaaaaacaacaaaacccctgagctggactgttgagcaggcctgtctctcctattaagtaaaaataaatagtagtagtatgtttgtaagctattctgacagaaaagacaaaggttactaattgtatgatagtgtttttatatggaagaatgtacagcttatggacaaatgtacacctttttgttactttaataaaaatgtagtaggataaaaaaaaa

The invention claimed is:

1. A method of identifying human oocytes that are capable of giving rise to a viable pregnancy when fertilized comprising the following steps: (i) obtaining at least one cumulus cell associated with an oocyte; (ii) assaying the expression of at least one gene by said at least one cumulus cell, the expression of which correlates to the capability of an oocyte associated with said cumulus cell to yield a viable pregnancy upon fertilization and transferal into a suitable uterine environment; and (iii) identifying, based on the level of expression of said at least one gene by said cumulus cell, whether said oocyte is potentially capable of yielding a viable pregnancy upon fertilization and transferal into a suitable uterine environment and wherein said at least one gene identified includes a gene selected from the group consisting of arginine methyl transferase (PRMT5), B-cell translocation gene 2 (BTG2), and beta actin gene (ACTB), that is expressed on average at elevated amounts in cumulus cells derived from oocytes that give rise to viable progeny versus those which do not and determining based on the level of expression of said at least one gene whether to use said oocyte in an in vitro fertilization (IVF) procedure.

2. The method of claim 1 wherein the expression of at least 10 genes, the expression of which correlates to the capability of an oocyte to potentially yield a viable pregnancy are measured.

3. The method of claim 2, wherein the expression of at least 15 genes, the expression of which correlates to the capability of an oocyte to potentially yield a viable pregnancy are identified.

4. The method of claim 3, wherein the expression of at least 20 genes, the expression of which correlates to the capability of an oocyte to potentially yield a viable pregnancy are identified.

5. The method of claim 4, wherein the expression of at least 20 to 50 genes, the expression of which correlates to the capability of an oocyte to potentially yield a viable pregnancy are identified.

6. The method of claim 5, wherein the expression of at least 50 to 100 genes, the expression of which correlates to the capability of an oocyte to potentially yield a viable pregnancy are identified.

7. The method of claim 1 wherein the method of assaying gene expression uses a method that monitors differential gene expression.

8. The method of claim 7 wherein said method comprises indexing differential display reverse transcriptase polymerase chain reaction (DDRT-PCR).

9. The method of claim 1, wherein the oocyte is obtained from a woman who is at least 25 years old.

10. The method of claim 1, wherein the oocyte is obtained from a woman who is at least 30 years old.

11. The method of claim 1, wherein the oocyte is obtained from a woman who is at no more than 35 years old.

12. The method of claim 1, wherein the oocyte is obtained from a woman who is at least 40 years old.

13. The method of claim 1, wherein an aberrant expression of said at least one gene is correlated to a condition selected from menopause, cancer, ovarian dysfunction, ovarian cyst, autoimmune disorder and hormonal dysfunction.

14. The method of claim 1, wherein gene expression is detected by real-time polymerase chain reaction (RT-PCR).

* * * * *